United States Patent
Duan et al.

(10) Patent No.: US 11,274,286 B2
(45) Date of Patent: Mar. 15, 2022

(54) ENGINEERED DEOXYRIBOSE-PHOSPHATE ALDOLASES

(71) Applicant: Codexis, Inc., Redwood City, CA (US)

(72) Inventors: Da Duan, Newark, CA (US); Oscar Alvizo, Fremont, CA (US); Jovana Nazor, Milpitas, CA (US); Harvinder Chagger Maniar, Hayward, CA (US); James Nicholas Riggins, San Francisco, CA (US); Jonathan Vroom, South San Francisco, CA (US); Santhosh Sivaramakrishnan, Redwood City, CA (US); Hao Yang, Rahway, NJ (US); Anna Fryszkowska, New York, NY (US); Mark A. Huffman, Rahway, NJ (US); Joshua N. Kolev, Rahway, NJ (US); Iman Farasat, Rahway, NJ (US); Agustina Rodriguez-Granillo, Rahway, NJ (US); Deeptak Verma, Rahway, NJ (US)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 16/460,118

(22) Filed: Jul. 2, 2019

(65) Prior Publication Data
US 2020/0010868 A1 Jan. 9, 2020

Related U.S. Application Data

(60) Provisional application No. 62/695,520, filed on Jul. 9, 2018, provisional application No. 62/822,273, filed on Mar. 22, 2019.

(51) Int. Cl.
*C12N 9/88* (2006.01)
*C12P 21/02* (2006.01)
*C12N 15/63* (2006.01)

(52) U.S. Cl.
CPC ............... *C12N 9/88* (2013.01); *C12N 15/63* (2013.01); *C12P 21/02* (2013.01); *C12Y 401/02004* (2013.01)

(58) Field of Classification Search
CPC ..................................................... C12N 9/88
See application file for complete search history.

(56) References Cited

U.S. PATENT DOCUMENTS

| | | | |
|---|---|---|---|
| 5,308,854 A | 5/1994 | Hoffman, Jr. et al. | |
| 5,527,819 A | 6/1996 | Williams et al. | |
| 5,605,793 A | 2/1997 | Stemmer | |
| 5,811,238 A | 9/1998 | Stemmer et al. | |
| 5,830,721 A | 11/1998 | Stemmer et al. | |
| 5,834,252 A | 11/1998 | Stemmer et al. | |
| 5,837,458 A | 11/1998 | Minshull et al. | |
| 5,928,905 A | 7/1999 | Stemmer et al. | |
| 6,096,548 A | 8/2000 | Stemmer | |
| 6,117,679 A | 9/2000 | Stemmer | |
| 6,132,970 A | 10/2000 | Stemmer | |
| 6,165,793 A | 12/2000 | Stemmer | |
| 6,180,406 B1 | 1/2001 | Stemmer | |
| 6,251,674 B1 | 6/2001 | Tobin et al. | |
| 6,265,201 B1 | 7/2001 | Wackett et al. | |
| 6,277,638 B1 | 8/2001 | Stemmer | |
| 6,287,861 B1 | 9/2001 | Stemmer et al. | |
| 6,287,862 B1 | 9/2001 | delCardayre et al. | |
| 6,291,242 B1 | 9/2001 | Stemmer | |
| 6,297,053 B1 | 10/2001 | Stemmer | |
| 6,303,344 B1 | 10/2001 | Patten et al. | |
| 6,309,883 B1 | 10/2001 | Minshull et al. | |
| 6,319,713 B1 | 11/2001 | Patten et al. | |
| 6,319,714 B1 | 11/2001 | Crameri et al. | |
| 6,323,030 B1 | 11/2001 | Stemmer | |
| 6,326,204 B1 | 12/2001 | delCardayre et al. | |
| 6,335,160 B1 | 1/2002 | Patten et al. | |
| 6,335,198 B1 | 1/2002 | delCardayre et al. | |
| 6,337,186 B1 | 1/2002 | Krebber | |
| 6,344,356 B1 | 2/2002 | Stemmer | |
| 6,352,859 B1 | 3/2002 | delCardayre et al. | |
| 6,355,484 B1 | 3/2002 | Patten et al. | |
| 6,358,740 B1 | 3/2002 | Patten et al. | |
| 6,358,742 B1 | 3/2002 | Stemmer | |
| 6,365,377 B1 | 4/2002 | Patten et al. | |
| 6,365,408 B1 | 4/2002 | Stemmer | |
| 6,368,861 B1 | 4/2002 | Crameri et al. | |
| 6,372,497 B1 | 4/2002 | Stemmer | |
| 6,376,246 B1 | 4/2002 | Crameri et al. | |
| 6,379,964 B1 | 4/2002 | delCardayre et al. | |
| 6,387,702 B1 | 5/2002 | Stemmer | |

(Continued)

FOREIGN PATENT DOCUMENTS

| | | |
|---|---|---|
| EP | 0137280 B1 | 11/1992 |
| WO | 95/22625 A1 | 8/1995 |

(Continued)

OTHER PUBLICATIONS

Studer. Residue mutations and their impact on protein structure and function: detecting beneficial and pathogenic changes. Biochem. J. (2013) 449, 581-594.*
Hong. A0A1E5ISV3. UnitProt/KB Database. Jan. 18, 2017.*
Copeland. DEOC_SHEHH. UnitProtKB Database. Jun. 7, 2017.*
Seilhamer. A0A1S2TZ70_9GAMM. UniProtKB Database. Jul. 5, 2017.*
Dick, M., et al., "Trading off stability against activity in extremophilic aldolases," Nature Specific Reports, 6(17908):1-6 [2016].
UniPROT Sequence A0A2I0DN74_9GAMM dated Feb. 28, 2018.
Takahashi, T., et al., "Efficient gene disruption in the koji-mold Aspergillus sojae using a novel variation of the positive-negative method," Mol. Gen. Genom., 272: 344-352 [2004].
Tiwari, S., et al., "Prediction of probable genes by Fourier analysis of genomic sequences," Comput. Appl. Biosci. 13(3):263-270 [1997].

(Continued)

*Primary Examiner* — Yong D Pak
(74) *Attorney, Agent, or Firm* — Codexis, Inc.

(57) ABSTRACT

The present invention provides engineered deoxyribose-phosphate aldolase polypeptides useful under industrial process conditions for the production of pharmaceutical and fine chemical compounds.

5 Claims, No Drawings
Specification includes a Sequence Listing.

(56) References Cited

U.S. PATENT DOCUMENTS

| | | |
|---|---|---|
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,605,430 B1 | 7/2003 | Affholter et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selfinov et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,270,992 B2 | 9/2007 | Shimizu et al. |
| 7,288,375 B2 | 10/2007 | Stemmer et al. |
| 7,384,387 B1 | 6/2008 | Raillard et al. |
| 7,399,627 B2 | 7/2008 | Emalfarb et al. |
| 7,421,347 B2 | 9/2008 | Selfinov et al. |
| 7,430,477 B2 | 9/2008 | Selfinov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selfinov et al. |
| 7,629,157 B2 | 12/2009 | Davis et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,477 B1 | 1/2011 | Gustafsson et al. |
| 7,873,499 B2 | 1/2011 | Selfinov et al. |
| 7,904,249 B2 | 3/2011 | Selfinov et al. |
| 7,927,842 B2 | 4/2011 | Shimizu et al. |
| 7,927,843 B2 | 4/2011 | Shimizu et al. |
| 7,957,912 B2 | 6/2011 | Selfinov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selfinov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selfinov et al. |
| 8,762,066 B2 | 6/2014 | Fox |
| 8,768,871 B2 | 7/2014 | Fox |
| 9,593,326 B2 | 3/2017 | Clark et al. |
| 2005/0153407 A1 | 7/2005 | Greenberg et al. |
| 2008/0220990 A1 | 9/2008 | Fox |
| 2009/0209001 A1* | 8/2009 | Schuermann ........... C12P 19/02 435/69.1 |
| 2009/0312196 A1 | 12/2009 | Colbeck et al. |
| 2011/0296543 A1 | 12/2011 | Chang et al. |
| 2013/0332133 A1 | 12/2013 | Horn et al. |
| 2016/0244787 A1 | 8/2016 | Chan et al. |
| 2017/0191095 A1 | 7/2017 | Marliere |

FOREIGN PATENT DOCUMENTS

| | | |
|---|---|---|
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2009/008908 A2 | 1/2009 |
| WO | 2009/152336 A1 | 12/2009 |
| WO | 2012/177527 A1 | 12/2012 |
| WO | 2015/181074 A1 | 12/2015 |

OTHER PUBLICATIONS

Truppo, M.D., et al., "Development of an Improved Immobilized CAL-B for the Enzymatic Resolution of a Key Intermediate to Odanacatib," Organic Process Research & Development, 15:1033-1035 (2011).

Uberbacher, E.C., et al., "Discovering and Understanding Genes in Human DNA Sequence Using GRAIL," Methods Enzymol., 266:259-281 [1996].

Villa-Komaroff, L., et al., "A bacterial clone synthesizing proinsulin," Proc. Natl Acad. Sci. USA, 75:3727-3731 (1978).

Wada, K., et al., "Codon usage tabulated from the GenBank genetic sequence data," Nucl Acids Res., 20:2111-2118 [1992].

Wells, J.A., et al., "Cassette mutagenesis: an efficient method for generation of multiple mutations at defined sites," Gene, 34:315-323 (1985).

Wilson, I.A., et al., "The structure of antigenic determinant in a protein," Cell, 37:767-778 [1984].

Wright, F., "The 'effective number of codons' used in a gene," Gene 87:23-29 [1990].

Yi, S., et al., "Covalent immobilization of omega-transaminase from Vibrio fluvialis JS17 on chitosan beads," Process Biochemistry 42(5): 895-898 (2007).

Uou, B., et al., "Gene-specif disruption in the fillamentous fungus Cercospora nicotianae using a split-marker approach," Arch Micriobiol., 191:615-622 [2009].

Zhang, J-H., et al., "Directed evolution of a fucosidase from a galactosidase by DNA shuffling and screening, " Proc. Nat. Acad. Sci., U.S.A., 94:4504-4509 (1997).

Hoffee, P., et al., "The Mechanism of Action of Aldolases: VI. Crystallization of Deoxyribose 5-Phosphate Aldolase and the Number of Active Sites," J Biological Chemistry, 240(4):1512-1516 [1965].

(56) References Cited

OTHER PUBLICATIONS

Bramski, J., et al., "Probing the acetaldehyde-sensitivity of 2-deoxyribose-5-phosphate aldolase (DERA) leads to resistant variants," J. Biotechnology, 258:56-58 [2017].
PubChem CID 45934311, Deoxyribose 5-phosphate, from https://pubchem.ncbi.nlm.nih.gov downloaded Apr. 25, 2018.
Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Barbas, III, C.F., et al., "Deoxyribose-5-phosphate Aldolase as a Synthetic Catalyst," J. Am. Chem. Soc., 112:2013-2014 [1990].
Beaucage, S.L., et al., "Deoxynucleoside phosphoamidites—A new class of key intermediates for deoxypolynucleotide synthesis," Tetrahedron Letters, 22(20): 1859-62 (1981).
Blaiseau, P-L., et al., "Primary structure of a chitinase-encoding gene (chi1) from the filamentous fungus Aphanocladium album: similarity to bacterial chitinases," Gene, 120:243-248 [1992].
Boel, E., et al., "Two different types of intervening sequences in the glucoamylase gene from Aspergillus niger," EMBO J., 3:1581-85 [1984].
Botstein, D., et al., "Strategies and applications of in vitro mutagenesis," Science, 229(4719):1193-1201, 1985.
Carter, P., "Site-directed mutagenesis," Biochem. J., 237:1-7 (1986).
Chaveroche, M., et al., "A rapid method for efficient gene replacement in the filamentous fungus Aspergillus nidulans," Nucl. Acids Res., 28:22 e97 [2000].
Cho, Y., et al., "A high throughput targeted gene disruption method for Alternaria brassicicola functional genomics using linear minimal element (LME) constructs," Mol Plant Microbe Interact, 19(1):7-15 [2006].
Christians, F.C., et al., "Directed evolution of thymidine kinase for AZT phosphorylation using DNA family shuffling," Nat. Biotechnol., 17:259-264 (1999).
Combier, J.-P., et al., "Agrobacterium tumefaciens-mediated transformation as a tool for insertional mutagenesis in the symbiotic ectomycorrhizal fungus Hebeloma cylindrosporum," FEMS Microbiol Lett., 220:141-8 [2003].
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15(5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80:21-25(1983).
Dean, S.M., et al., "Recent Advances in Aldolase-Catalyzed Asymmetric Synthesis," Adv. Synth. Catal., 349(8-9): 1308-1320 [2007].
Ehrlich, S.D.,"DNA cloning in Bacillus subtilis," Proc. Natl. Acad. Sci. USA, 75(3):1433-1436 [1978].
Eisenberg, D., et al., "Analysis of Membrane and Surface Protein Sequences with the Hydrophobic Moment Plot," J. Mol. Biol., 179:125-142 [1984].
Firon, A., et al., "Identification of Essential Genes in the Human Fungal Pathogen Aspergillus fumigatus by Transposon Mutagenesis," Eukaryot. Cell, 2(2):247-55 [2003].
Guo, Z., et al., "3'-End-Forming Signals of Yeast mRNA," Mol. Cell. Biol., 15(11):5983-5990 [1995].
Henaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.

Henikoff, S., et al., "Amino acid substitution matrices from protein blocks," Proc. Natl. Acad. Sci. USA, 89:10915-10919 [1992].
Hong, J., et al., "Cloning and functional expression of thermostable beta-glucosidase gene from Thermoascus aurantiacus," Appl. Microbiol. Biotechnol, 73:1331-1339 [2007].
Koszelewski, D., et al., "Immobilization of omega-transaminases by encapsulation in a sol-gel/celite matrix," Journal of Molecular Catalysis B: Enzymatic, 63: 39-44 (2010).
Kramer, B., et al., "Different base/base mismatches are corrected with different efficiencies by the methyl-directed DNA mismatch-repair system of E. coli," Cell, 38(3):879-887 [1984].
Lathe, R., et al., "Plasmid and bacteriolphage vecotrs for excision of intact inserts," Gene, 57:193-201 [1987].
Limon, C., et al., "Primary structure and expression pattern of the 33-kDa chitinase gene from the nucoparasitic fungus Trichocherma harzianum," Curr. Genet., 28:478-83 [1995].
Ling, M.M., et al., "Approaches to DNA Mutagenesis: An Overview," Anal. Biochem., 254(2):157-78 [1997].
Martin, A.R., et al., "Characterization of free and immobilized (S)-aminotransferase for acetophenone production," Applied Microbiology and Biotechnology, 76(4): 843-851 (2007).
Maruyama, J., "Multiple gene disruptions by marker recycling with highly efficient gene-targeting background (delta-igD) in Aspergillus oryzae," Biotechnol Lett., 30:1811-1817 [2008].
Mateo, C., et al., "Epoxy sepabeads: a novel epoxy support for stabilization of industrial enzymes via very intense multipoint covalent attachment," Biotechnology Progress 18(3):629-34 (2002).
Matthes, H.W.D., et al., "Simultaneous rapid chemical synthesis of over one hundred oligonucleotides on a microscale," EMBO J., 3(4):801-05 (1984).
McInerney, J.O., "GCUA: general codon usage analysis," Bioinformatics, 14(4):372-73 [1998].
Minshull, J., et al., "Protein evolution by molecular breeding," Curr. Op. Chem. Biol., 3(3):284-290 (1999).
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Nunberg, J.H., et al., "Molecular Cloning and Characterization of the Glucoamylase Gene of Aspergillus awamori," Mol. Cell Biol., 4(11):2306-2315 [1984].
Parry, N.J., et al., "Biochemical characterization and mechanism of action of a thermostablebeta-glucosidase purified from Thermoascus aurantiacus," Biochem. J., 353:117-127 [2001].
Pearson, W.R., "Improved tools for biological sequence comparison," Proc. Natl. Acad. Sci. USA, 85:2444-2448 (1988).
Porath, J., "Immobilized metal ion affinity chromatography," Protein Expression and Purification, 3:263-281 (1992).
Racker, E., "Enzymatic Synthesis and Breakdown of Desoxyribose Phosphate," J. Biol. Chem., 196:347-365 [1952].
Romanos, M.A., et al., "Foreign gene expression in yeast: a review," Yeast 8:423-488 [1992].
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Stenico, M., et al., "Codon usage in Caenorhabditis elegans: delineation of translational selection and mutational biases," Nucl. Acids Res. 22(13):2437-46 [1994].

\* cited by examiner

US 11,274,286 B2

ENGINEERED DEOXYRIBOSE-PHOSPHATE ALDOLASES

The present application claims priority to U.S. Prov. Pat. Appln. Ser. No. 62/695,520, filed Jul. 9, 2018 and U.S. Prov. Pat. Appln. Ser. No. 62/822,273, filed Mar. 22, 2019, both of which are incorporated by reference in its entirety, for all purposes.

FIELD OF THE INVENTION

The present invention provides engineered deoxyribose-phosphate aldolase polypeptides useful under industrial process conditions for the production of pharmaceutical and fine chemical compounds.

REFERENCE TO SEQUENCE LISTING, TABLE OR COMPUTER PROGRAM

The official copy of the Sequence Listing is submitted concurrently with the specification as an ASCII formatted text file via EFS-Web, with a filename of "CX2-173WO2_ST25.txt", a creation date of Jun. 27, 2019, and a size of 832 kilobytes. The Sequence Listing filed via EFS-Web is part of the specification and incorporated in its entirety by reference herein.

BACKGROUND

The retrovirus designated as human immunodeficiency virus (HIV) is the etiological agent of acquired immune deficiency syndrome (AIDS), a complex disease that involves progressive destruction of affected individuals' immune systems and degeneration the central and peripheral nervous systems. A common feature of retrovirus replication is reverse transcription of the viral RNA genome by a virally-encoded reverse transcriptase to generate DNA copies of HIV sequences, required for viral replication. Some compounds, such as azidothymidine (AZT) are known reverse transcriptase inhibitors and have found use in the treatment of AIDS and similar diseases. While there are some compounds known to inhibit HIV reverse transcriptase, there remains a need in the art for additional compounds that are more effective in inhibiting this enzyme and thereby ameliorating the effects of AIDS.

SUMMARY OF THE INVENTION

The present invention provides engineered deoxyribose-phosphate aldolase polypeptides useful under industrial process conditions for the production of pharmaceutical and fine chemical compounds.

The present invention provides engineered deoxyribose-phosphate aldolases comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NOS: 2, 6, and/or 466, or a functional fragment thereof, wherein the engineered deoxyribose-phosphate aldolase comprises at least one substitution or substitution set in the polypeptide sequence, and wherein the amino acid positions of the polypeptide sequence are numbered with reference to SEQ ID NO: 2, or 6. In some embodiments, the polypeptide sequences of the engineered deoxyribose-phosphate aldolase have at least 85%, 86%, 87%, 88%, 89%, 90%, 91%, 92%, 93%, 94%, 95%, 96%, 97%, 98%, 99%, or more sequence identity to SEQ ID NO: 2, wherein the engineered deoxyribose-phosphate aldolase comprises at least one substitution or substitution set in the polypeptide sequence at one or more positions selected from 2, 6, 9, 10/47/66/141/145/156, 10/47/88/156, 13, 31, 46, 47, 47/134/141/212, 66, 66/88/112/134/141/143/145/212, 71, 72, 88, 94, 102, 104, 112, 116, 133, 133/173/204/235/236, 134, 145, 145/173, 147, 173, 184, 189, 197, 203, 204, 207, 226, 235, 235/236, and 236, and wherein the amino acid positions of the polypeptide sequence are numbered with reference to SEQ ID NO: 2. In some embodiments, the polypeptide sequences of the engineered deoxyribose-phosphate aldolase have at least 85%, 86%, 87%, 88%, 89%, 90%, 91%, 92%, 93%, 94%, 95%, 96%, 97%, 98%, 99%, or more sequence identity to SEQ ID NO:2, wherein the engineered deoxyribose-phosphate aldolase comprises at least one substitution or substitution set in the polypeptide selected from 2C, 2R, 2W, 6H, 6W, 6Y, 9R, 10R/47M/66P/141T/145K/156I, 10R/47M/88A/156I, 13I, 13L, 13Q, 13R, 31L, 46V, 47M, 47M/134L/141T/212Y, 47V, 66I, 66L, 66P, 66P/88A/112A/134L/141T/143E/145K/212Y, 66S, 66T, 71V, 72C, 88R, 88T, 94K, 94L, 94M, 102E, 104T, 112H, 112K, 112L, 112M, 112R, 116G, 116P, 133I/173V/204T/235D/236H, 133L, 133M, 134L, 134V, 145C, 145R, 145V/173R, 147A, 147K, 147S, 173P, 173T, 184I, 184V, 189A, 189R, 197C, 197M, 203I, 204T, 207G, 226S, 235D, 235D/236R, 235T, 236C, and 236D, and wherein the amino acid positions of the polypeptide sequence are numbered with reference to SEQ ID NO: 2. In some embodiments, the polypeptide sequences of the engineered deoxyribose-phosphate aldolase have at least 85%, 86%, 87%, 88%, 89%, 90%, 91%, 92%, 93%, 94%, 95%, 96%, 97%, 98%, 99%, or more sequence identity to SEQ ID NO:2, wherein the engineered deoxyribose-phosphate aldolase comprises at least one substitution or substitution set in the polypeptide selected from S2C, S2R, S2W, K6H, K6W, K6Y, Q9R, Q10R/C47M/D66P/S141T/A145K/L156I, Q10R/C47M/L88A/L156I, S13L, S13L, S13Q, S13R, E31L, I46V, C47M, C47M/I134L/S141T/F212Y, C47V, D66I, D66L, D66P, D66P/L88A/E112A/I134L/S141T/V143E/A145K/F212Y, D66S, D66T, A71V, T72C, L88R, L88T, V94K, V94L, V94M, D102E, V104T, E112H, E112K, E112L, E112M, E112R, T116G, T116P, T133I/A173V/K204T/S235D/S236H, T133L, T133M, I134L, I134V, A145C, A145R, A145V/A173R, P147A, P147K, P147S, A173P, A173T, M184I, M184V, S189A, S189R, F197C, F197M, V203I, K204T, A207G, T226S, S235D, S235D/S236R, S235T, S236C, and S236D, and wherein the amino acid positions of the polypeptide sequence are numbered with reference to SEQ ID NO: 2.

In some embodiments, the engineered deoxyribose-phosphate aldolase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:6, wherein the engineered deoxyribose-phosphate aldolase comprises at least one substitution or substitution set in the polypeptide sequence at one or more positions selected from 2, 2/6/10/66/88/102/184/235/236, 2/6/102/141/203/235, 2/10/102/235/236, 2/47/66/71/141/184/203/235/236, 2/47/71/88/203/235/236, 2/47/71/141/197/235/236, 2/88/141/235/236, 2/203/235/236, 5, 6/203/235/236, 9, 10/47/66/184/197/236, 10/47/66/235/236, 10/47/71/184/203/235/236, 13, 13/46, 13/46/66/94, 13/46/66/94/184/204, 13/46/66/133/134/184, 13/46/66/184, 13/46/112/134/184, 13/46/133/184, 13/66/94, 13/66/94/184, 13/66/112/133/134/184/204, 13/66/112/133/134/204, 13/66/112/184, 13/66/133/134/184/204, 13/66/184/204, 13/94/133/184, 13/94/184, 13/94/184/204, 13/133/134/184, 13/133/134/204, 13/134/204, 13/184, 27, 40, 46/66/94/112, 46/66/112/133/134/184, 46/66/133/134, 46/66/133/184/197, 46/66/133/197, 46/66/134/184/197/204, 46/66/184, 46/112/133, 46/112/133/134/204, 46/133/204, 46/197/204, 47/66/71/88/203/235/236, 47/66/71/141/184, 47/66/88/184/235, 47/66/88/203/235/236, 47/66/141/235/236, 47/66/184/197/203/235/236, 47/66/184/197/236, 47/71/88/184/203/235, 47/71/88/184/203/236, 47/71/141/184/203/235, 47/71/184, 47/71/184/197/236, 47/71/184/235, 47/71/184/236, 47/88/102/141/235/236, 47/88/203/235/236, 47/88/235/236, 47/102/184/197/235/236, 47/102/203/235/236, 47/141/184, 47/141/184/236, 47/184/236, 47/203/235, 47/203/235/236, 47/203/236, 47/235/236, 62, 66, 66/88/102/184/197/203/235/236, 66/88/197, 66/88/235, 66/88/235/236, 66/94, 66/94/112/133/184, 66/94/112/184/204, 66/102/184/235/236, 66/112/133/134/197, 66/112/133/197, 66/112/134/197, 66/112/184, 66/133/184, 66/133/197, 66/184, 66/197/203/235, 84, 88, 88/102/141/184/235/236, 88/184, 88/184/197/203/235/236, 88/184/197/235/236, 88/184/203/235, 88/184/236, 88/197/235/236, 88/236, 94/112/184/197, 94/133/184, 96, 102/141/203, 102/184/203/236, 102/184/236, 102/197/235, 112, 112/133/134, 112/133/184/204, 112/134/197, 114, 115, 120, 127, 132, 133, 133/134/184, 141/184/203/235/236, 141/184/235, 141/197, 141/203/235/236, 141/236, 146, 148, 184, 184/203, 184/203/235, 184/203/236, 184/235/236, 184/236, 197/235, 203/235/236, 203/236, 204, 218, 235, 235/236, and 236, and wherein the amino acid positions of the polypeptide sequence are numbered with reference to SEQ ID NO: 6. In some embodiments, the polypeptide sequences of the engineered deoxyribose-phosphate aldolase have at least 85%, 86%, 87%, 88%, 89%, 90%, 91%, 92%, 93%, 94%, 95%, 96%, 97%, 98%, 99%, or more sequence identity to SEQ ID NO:6, wherein the engineered deoxyribose-phosphate aldolase comprises at least one substitution or substitution set in the polypeptide selected from 2C/47V/66L/71V/141S/184I/203I/235T/236D, 2C/47V/71V/88A/203I/235T/236D, 2C/47V/71V/141S/197M/235T/236D, 2N, 2R/6H/10Q/66L/88A/102E/184I/235T/236D, 2R/6H/102E/141S/203I/235T, 2R/10Q/102E/235T/236D, 2R/88A/141S/235D/236D, 2R/203I/235T/236D, 5R, 6H/203I/235T/236D, 9K, 9L, 10Q/47V/66L/184I/197M/236D, 10Q/47V/66L/235T/236D, 10Q/47V/71V/184I/203I/235T/236D, 13I, 13I/46V, 13I/46V/66S/94L, 13I/46V/66S/94L/184V/204T, 13I/46V/66S/133L/134L/184V, 13I/46V/66S/184V, 13I/46V/112K/134L/184V, 13I/46V/133L/184V, 13I/46V/133M/184V, 13I/66S/94L, 13I/66S/94L/184V, 13I/66S/112K/133M/134L/184V/204T, 13I/66S/112K/133M/134L/204T, 13I/66S/112M/184V, 13I/66S/133M/134L/184V/204T, 13I/66S/184V/204T, 13I/94L/133M/184V, 13I/94L/184V, 13I/94L/184V/204T, 13I/133M/134L/184V, 13I/133M/134L/204T, 13I/134L/204T, 13I/184V, 13L, 13T, 27R, 40W, 46V/66S/94L/112K, 46V/66S/112K/133L/134L/184V, 46V/66S/133L/134L, 46V/66S/133L/184V/197C, 46V/66S/133M/197C, 46V/66S/134/184V/197C/204T, 46V/66S/184V, 46V/112K/133L/134L/204T, 46V/112M/133L, 46V/133M/204T, 46V/197C/204T, 47V/66L/71V/88A/203I/235T/236D, 47V/66L/71V/141S/184I, 47V/66L/88A/184I/235T, 47V/66L/88A/203I/235T/236D, 47V/66L/141S/235T/236D, 47V/66L/184I/197M/203I/235T/236D, 47V/66L/184I/197M/236D, 47V/71V/88A/184I/203I/235D, 47V/71V/88A/184I/203I/236D, 47V/71V/141S/184I/203I/235D, 47V/71V/184I, 47V/71V/184I/197M/236D, 47V/71V/184I/235T, 47V/71V/184I/236D, 47V/88A/102E/141S/235T/236D, 47V/88A/203I/235D/236D, 47V/88A/235T/236D, 47V/102E/184I/197M/235T/236D, 47V/102E/203I/235T/236D, 47V/141S/184I, 47V/141S/184I/236D, 47V/184I/236D, 47V/203I/235D, 47V/203I/235T/236D, 47V/203I/236D, 47V/235T/236D, 62L, 66A, 66C, 66H, 66L/88A/102E/184I/197M/203I/235T/236D, 66L/88A/197M, 66L/88A/235D, 66L/88A/235T/236D, 66L/102E/184I/235D/236D, 66L/184I, 66L/197M/203I/235D, 66S/94L, 66S/94L/112K/133L/184V, 66S/94L/112K/184V/204T, 66S/94L/112M/133M/184V, 66S/112K/133L/134L/197C, 66S/112K/134L/197C, 66S/112K/184V, 66S/112M/133L/197C, 66S/133L/197C, 66S/133M/184V, 66S/184V, 84C, 84L, 88A/102E/141S/184I/235T/236D, 88A/184I, 88A/184I/197M/203I/235T/236D, 88A/184I/197M/235D/236D, 88A/184I/203I/235D, 88A/184I/236D, 88A/197M/235T/236D, 88A/236D, 88H, 88V, 94L/112M/184V/197C, 94L/133L/184V, 96L, 102E/141S/203I, 102E/184I/203I/236D, 102E/184I/236D, 102E/197M/235D, 112C, 112K/133L/184V/204T, 112K/133M/134L, 112K/134L/197C, 112N, 114R, 115D, 115V, 120M, 120R, 127G, 127H, 127L, 127R, 127T, 127V, 132L, 133G, 133H, 133L, 133M/134L/184V, 133R, 141S/184I/203I/235T/236D, 141S/184I/235D, 141S/197M, 141S/203I/235D/236D, 141S/236D, 146Q, 148G, 148L, 184I/203I, 184I/203I/235D, 184I/203I/236D, 184I/235T/236D, 184I/236D, 184V, 197M/235D, 203I/235T/236D, 203I/236D, 204T, 218S, 235D/236D, 235T, 235T/236D, and 236D, and wherein the amino acid positions of the polypeptide sequence are numbered with reference to SEQ ID NO: 6. In some embodiments, the polypeptide sequences of the engineered deoxyribose-phosphate aldolase comprise at least 85%, 86%, 87%, 88%, 89%, 90%, 91%, 92%, 93%, 94%, 95%, 96%, 97%, 98%, 99%, or more sequence identity to SEQ ID NO:6, wherein the engineered deoxyribose-phosphate aldolase comprises at least one substitution or substitution set in the polypeptide selected from S2C/M47V/P66L/A71V/T141S/M184I/V203I/S235T/S236D, S2C/M47V/A71V/L88A/V203I/S235T/S236D, S2C/M47V/A71V/T141S/F197M/S235T/S236D, S2N, S2R/K6H/R10Q/P66L/L88A/D102E/M184I/S235T/S236D, S2R/K6H/D102E/T141SN203I/S235T, S2R/R10Q/D102E/S235T/S236D, S2R/L88A/T141S/S235D/S236D, S2R/V203I/S235T/S236D, K5R, K6H/V203I/S235T/S236D, Q9K, Q9L, R10Q/M47V/P66L/M184I/F197M/S236D, R10Q/M47V/P66L/S235T/S236D, R10Q/M47V/A71V/M184I/V203I/S235T/S236D, S13I, S13I/I46V, S13I/I46V/P66S/V94L, S13I/I46V/P66S/V94L/M184V/K204T, S13I/I46V/P66S/T133L/I134L/M184V, S13I/I46V/P66S/M184V, S13I/I46V/E112K/I134L/M184V, S13I/I46V/T133L/M184V, S13I/I46V/T133M/M184V, S13I/P66S/V94L, S13I/P66S/V94L/M184V, S13I/P66S/E112K/T133M/I134L/M184V/K204T, S13I/P66S/E112K/T133M/I134L/K204T, S13I/P66S/E112M/M184V, S13I/P66S/T133M/I134L/M184V/K204T, S13I/P66S/M184V/K204T, S13I/V94L/T133M/M184V, S13I/V94L/M184V, S13I/V94L/M184V/K204T, S13I/T133M/I134L/M184V, S13I/T133M/I134L/K204T, S13I/I134L/K204T, S13I/M184V, S13L, S13T, Q27R, A40W, I46V/P66S/V94L/E112K, I46V/P66S/E112K/T133L/I134L/M184V, I46V/P66S/T133L/I134L, I46V/P66S/T133L/M184V/F197C, I46V/P66S/T133M/F197C, I46V/P66S/I134L/M184V/F197C/K204T, I46V/P66S/M184V, I46V/E112K/T133L/I134L/K204T, I46V/E112M/T133L, I46V/T133M/K204T, I46V/F197C/K204T, M47V/P66L/A71V/L88A/V203I/S235T/S236D, M47V/P66L/A71V/T141S/M184I, M47V/P66L/L88A/M184I/S235T, M47V/P66L/L88A/V203I/S235T/S236D, M47V/P66L/T141S/S235T/S236D, M47V/P66L/M184I/F197M/V203I/S235T/S236D, M47V/P66L/M184I/F197M/S236D, M47V/A71V/L88A/M184I/V203I/S235D, M47V/A71V/L88A/M184I/V203I/S236D, M47V/A71V/T141S/M184I/V203I/S235D, M47V/A71V/M184I, M47V/A71V/M184I/F197M/S236D, M47V/A71V/M184I/S235T, M47V/A71V/M184I/S236D, M47V/L88A/D102E/

T141S/S235T/S236D, M47V/L88A/V203I/S235D/S236D, M47V/L88A/S235T/S236D, M47V/D102E/M184I/F197M/S235T/S236D, M47V/D102E/V203I/S235T/S236D, M47V/T141S/M184I, M47V/T141S/M184I/S236D, M47V/M184I/S236D, M47V/V203I/S235D, M47V/V203I/S235T/S236D, M47V/V203I/S236D, M47V/S235T/S236D, E62L, P66A, P66C, P66H, P66L/L88A/D102E/M184I/F197M/V203I/S235T/S236D, P66L/L88A/F197M, P66L/L88A/S235D, P66L/L88A/S235T/S236D, P66L/D102E/M184I/S235D/S236D, P66L/M184I, P66L/F197M/V203I/S235D, P66SN94L, P66S/V94L/E112K/T133L/M184V, P66S/V94L/E112K/M184V/K204T, P66S/V94L/E112M/T133M/M184V, P66S/E112K/T133L/I134L/F197C, P66S/E112K/I134L/F197C, P66S/E112K/M184V, P66S/E112M/T133L/F197C, P66S/T133L/F197C, P66S/T133M/M184V, P66S/M184V, A84C, A84L, L88A/D102E/T141S/M184I/S235T/S236D, L88A/M184I, L88A/M184I/F197M/V203I/S235T/S236D, L88A/M184I/F197M/S235D/S236D, L88A/M184I/V203I/A235I, L88A/M184I/S236D, L88A/F197M/S235T/S236D, L88A/S236D, L88H, L88V, V94L/E112M/M184V/F197C, V94L/T133L/M184V, Y96L, D102E/T141S/V203I, D102E/M184I/V203I/S236D, D102E/M184I/S236D, D102E/F197M/S235D, E112C, E112K/T133L/M184V/K204T, E112K/T133M/I134L, E112K/I134L/F197C, E112N, N114R, E115D, E115V, E120M, E120R, E127G, E127H, E127L, E127R, E127T, E127V, D132L, T133G, T133H, T133L, T133M/I134L/M184V, T133R, T141S/M184I/V203I/S235T/S236D, T141S/M184I/S235D, T141S/F197M, T141S/V203I/S235D/S236D, T141S/S236D, D146Q, A148G, A148L, M184I/V203I, M184/V203I/S235D, M184I/V203I/S236D, M184I/S235T/S236D, M184I/S236D, M184V, F197M/S235D, V203I/S235T/S236D, V203I/S236D, K204T, R218S, S235D/S236D, S235T, S235T/S236D, and S236D, and wherein the amino acid positions of the polypeptide sequence are numbered with reference to SEQ ID NO: 6.

In some embodiments, the polypeptide sequences of the engineered deoxyribose-phosphate aldolase have at least 85%, 86%, 87%, 88%, 89%, 90%, 91%, 92%, 93%, 94%, 95%, 96%, 97%, 98%, 99%, or more sequence identity to SEQ ID NO: 466, wherein the engineered deoxyribose-phosphate aldolase comprises at least one substitution or substitution set in the polypeptide sequence at one or more positions selected from 71/88/94/133, 71/133, and 133, and wherein the amino acid positions of the polypeptide sequence are numbered with reference to SEQ ID NO: 466. In some embodiments, the polypeptide sequences of the engineered deoxyribose-phosphate aldolase have at least 85%, 86%, 87%, 88%, 89%, 90%, 91%, 92%, 93%, 94%, 95%, 96%, 97%, 98%, 99%, or more sequence identity to SEQ ID NO: 466, wherein the engineered deoxyribose-phosphate aldolase comprises at least one substitution or substitution set in the polypeptide selected from 71A/88A/94L/133H, 71A/133H, and 133H, and wherein the amino acid positions of the polypeptide sequence are numbered with reference to SEQ ID NO: 466. In some embodiments, the polypeptide sequences of the engineered deoxyribose-phosphate aldolase have at least 85%, 86%, 87%, 88%, 89%, 90%, 91%, 92%, 93%, 94%, 95%, 96%, 97%, 98%, 99%, or more sequence identity to SEQ ID NO: 466, wherein the engineered deoxyribose-phosphate aldolase comprises at least one substitution or substitution set in the polypeptide selected from V71A/L88A/V94L/T133H, V71A/T133H, and T133H, and wherein the amino acid positions of the polypeptide sequence are numbered with reference to SEQ ID NO: 466.

The present invention also provides engineered deoxyribose-phosphate aldolases comprising polypeptide sequences that are at least 85%, 86%, 87%, 88%, 89%, 90%, 91%, 92%, 93%, 94%, 95%, 96%, 97%, 98%, 99% or more identical to the sequence of at least one engineered deoxyribose-phosphate aldolase variant set forth in Table 3.1, 4.1, and/or 6.1. In some embodiments, the engineered deoxyribose-phosphate aldolase is a variant engineered polypeptide provided in Table 3.1, 4.1, and/or 6.1. In some embodiments, the engineered deoxyribose-phosphate aldolase comprises a polypeptide sequence that is at least 85%, 86%, 87%, 88%, 89%, 90%, 91%, 92%, 93%, 94%, 95%, 96%, 97%, 98%, 99% or more identical to the sequence of at least one engineered deoxyribose-phosphate aldolase variant set forth in SEQ ID NO: 2, 6, and/or 466. In some additional embodiments, the engineered deoxyribose-phosphate aldolase is a variant engineered polypeptide set forth in SEQ ID NO: 2, 6, and/or 466. In some further embodiments, the engineered deoxyribose-phosphate aldolase comprises a polypeptide sequence that is at least 85%, 86%, 87%, 88%, 89%, 90%, 91%, 92%, 93%, 94%, 95%, 96%, 97%, 98%, 99% or more identical to the sequence of at least one engineered deoxyribose-phosphate aldolase variant set forth in the even numbered sequences of SEQ ID NOS: 2-478. In yet some additional embodiments, the engineered deoxyribose-phosphate aldolase comprises a polypeptide sequence forth in the even numbered sequences of SEQ ID NOS: 2-478. In some embodiments, the engineered deoxyribose-phosphate aldolase comprises at least one improved property compared to wild-type *Shewanella halifaxensis* deoxyribose-phosphate aldolase. In some additional embodiments, the improved property comprises improved activity on a substrate. In some further embodiments, the substrate comprises R-2-ethynyl-glyceraldehyde. In yet some further embodiments, the improved property comprises improved thermostability. In still some additional embodiments, the engineered deoxyribose-phosphate aldolase is purified. The present invention also provides compositions comprising at least one engineered deoxyribose-phosphate aldolase provided herein.

The present invention also provides polynucleotide sequences encoding at least one engineered deoxyribose-phosphate aldolase provided herein. In some embodiments, the engineered polynucleotide sequence encodes at least one engineered deoxyribose-phosphate aldolase, wherein the polynucleotide sequence comprises at least 85%, 86%, 87%, 88%, 89%, 90%, 91%, 92%, 93%, 94%, 95%, 96%, 97%, 98%, 99%, or more sequence identity to SEQ ID NO: 1, 5, and/or 465. The present invention also provides polynucleotide sequences encoding at least one engineered deoxyribose-phosphate aldolase provided herein. In some additional embodiments, the engineered polynucleotide sequence encodes at least one engineered deoxyribose-phosphate aldolase, wherein the polynucleotide sequence comprises at least 85%, 86%, 87%, 88%, 89%, 90%, 91%, 92%, 93%, 94%, 95%, 96%, 97%, 98%, 99%, or more sequence identity to SEQ ID NO: 1, 5, and/or 465, wherein the polynucleotide sequence of the engineered deoxyribose-phosphate aldolase comprises at least one substitution at one or more positions. In some further embodiments, the engineered polynucleotide sequence encoding at least one engineered deoxyribose-phosphate aldolase comprises at least 85%, 86%, 87%, 88%, 89%, 90%, 91%, 92%, 93%, 94%, 95%, 96%, 97%, 98%, 99%, or more sequence identity to SEQ ID NO: 2, 6, and/or 466, or a functional fragment thereof. In yet some additional embodiments, the engineered polynucleotide sequence comprises a sequence forth in the odd numbered sequences of SEQ ID NOS: 1-477. In some further embodiments, the polynucleotide sequence is operably linked to a control sequence. In yet some additional embodiments, the engineered polynucleotide sequence is codon optimized. The present invention also provides expression vectors comprising at least one polynucleotide sequence provided herein. The present invention further provides host cells comprising at least one expression vector provided herein. In some embodiments, the host cell comprises at least one polynucleotide sequence provided herein.

The present invention also provides methods of producing an engineered deoxyribose-phosphate aldolase in a host cell, comprising culturing the host cell provided herein, in a culture medium under suitable conditions, such that at least one engineered deoxyribose-phosphate aldolase is produced. In some embodiments, the methods further comprise recovering at least one engineered deoxyribose-phosphate aldolase from the culture medium and/or host cell. In some additional embodiments, the methods further comprise the step of purifying the at least one engineered deoxyribose-phosphate aldolase.

DESCRIPTION OF THE INVENTION

The present invention provides engineered deoxyribose-phosphate aldolase polypeptides useful under industrial process conditions for the production of pharmaceutical and fine chemical compounds.

Deoxyribose-phosphate aldolase (DERA; EC 4.1.2.4) catalyzes the reversible aldol reaction of acetaldehyde and D-glyceraldehyde 3-phosphate to produce 2-deoxyribose-5-phosphate (Se e.g., Barbas et al., J. Am. Chem. Soc., 112: 2013-2014 [1990]). Synonyms include phosphodeoxyriboaldose, deoxyriboaldolase, deoxyribose-5-phosphate aldolase, 2-deoxyribose-5-phosphate aldolase, and 2-deoxy-D-ribose-5-phosphate acetaldehyde-lyase. It is involved in the pentose phosphate pathway and is widely distributed in microorganisms and animal tissue (See, Racker, J. Biol. Chem., 196:347-365 [1952]). As it is a class I aldolase, it is cofactor independent and activates its donor substrate by the formation of a Schiff base with a strictly conserved active site lysine (See, US Pat. Appln. Publ. No. 2017/0191095; and Dean et al., Adv. Synth. Catal., 349: 1308-1320 [2007]). In the present invention, enantiopure (R)-2-ethynyl-glyceraldehyde (Compound X) is selectively transformed into (4S,5R)-5-ethynyl-deoxyribose (Compound Y) by a deoxyribose-phosphate adolase (DERA) in the presence of acetaldehyde (See the reaction below).

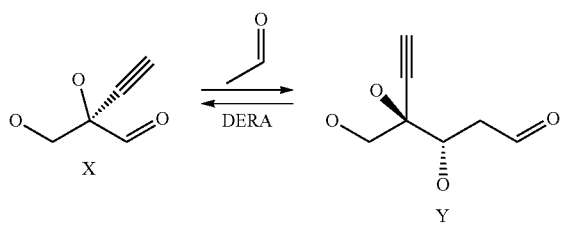

In some embodiments, Compound Y is then transformed into 5-phospho-deoxyribose-alkyne via phosphorylation by a phosphatase, for utilization in an additional reaction, such as that needed to produce nucleoside reverse transcriptase translocation inhibitors (NRTTIs) suitable for the treatment and prevention of HIV. Chemical synthesis of 5-phospho-deoxyribose-alkyne (5-P) is very challenging. Thus, the present invention provides an alternative biocatalytic route that is much desired in the art.

For the descriptions provided herein, the use of the singular includes the plural (and vice versa) unless specifically stated otherwise. For instance, the singular forms "a", "an" and "the" include plural referents unless the context clearly indicates otherwise. Similarly, "comprise," "comprises," "comprising" "include," "includes," and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

Both the foregoing general description, including the drawings, and the following detailed description are exemplary and explanatory only and are not restrictive of this invention. Moreover, the section headings used herein are for organizational purposes only and not to be construed as limiting the subject matter described.

Definitions

As used herein, the following terms are intended to have the following meanings. In reference to the present invention, the technical and scientific terms used in the descriptions herein will have the meanings commonly understood by one of ordinary skill in the art, unless specifically defined otherwise. Accordingly, the following terms are intended to have the following meanings. In addition, all patents and publications, including all sequences disclosed within such patents and publications, referred to herein are expressly incorporated by reference.

Unless otherwise indicated, the practice of the present invention involves conventional techniques commonly used in molecular biology, fermentation, microbiology, and related fields, which are known to those of skill in the art. Unless defined otherwise herein, all technical and scientific terms used herein have the same meaning as commonly understood by one of ordinary skill in the art to which this invention belongs. Although any methods and materials similar or equivalent to those described herein can be used in the practice or testing of the present invention, the preferred methods and materials are described. Indeed, it is intended that the present invention not be limited to the particular methodology, protocols, and reagents described herein, as these may vary, depending upon the context in which they are used. The headings provided herein are not limitations of the various aspects or embodiments of the present invention that can be had by reference to the specification as a whole. Accordingly, the terms defined below are more fully defined by reference to the specification as a whole.

Nonetheless, in order to facilitate understanding of the present invention, a number of terms are defined below. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used herein, the term "comprising" and its cognates are used in their inclusive sense (i.e., equivalent to the term "including" and its corresponding cognates).

As used herein and in the appended claims, the singular "a", "an" and "the" include the plural reference unless the context clearly dictates otherwise. Thus, for example, reference to a "host cell" includes a plurality of such host cells.

Unless otherwise indicated, nucleic acids are written left to right in 5' to 3' orientation and amino acid sequences are written left to right in amino to carboxy orientation, respectively.

As used herein, the terms "protein," "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes. The abbreviations used for the genetically encoded amino acids are conventional and are as follows: alanine (Ala or A), arginine (Are or R), asparagine (Asn or N), aspartate (Asp or D), cysteine (Cys or C), glutamate (Glu or E), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V).

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

As used herein, "hydrophilic amino acid or residue" refers to an amino acid or residue having a side chain exhibiting a hydrophobicity of less than zero according to the normalized consensus hydrophobicity scale of Eisenberg et al., (Eisenberg et al., J. Mol. Biol., 179:125-142 [1984]). Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

As used herein, "acidic amino acid or residue" refers to a hydrophilic amino acid or residue having a side chain exhibiting a pK value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

As used herein, "basic amino acid or residue" refers to a hydrophilic amino acid or residue having a side chain exhibiting a pK value of greater than about 6 when the amino acid is included in a peptide or polypeptide. Basic amino acids typically have positively charged side chains at physiological pH due to association with hydronium ion. Genetically encoded basic amino acids include L-Arg (R) and L-Lys (K).

As used herein, "polar amino acid or residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

As used herein, "hydrophobic amino acid or residue" refers to an amino acid or residue having a side chain exhibiting a hydrophobicity of greater than zero according to the normalized consensus hydrophobicity scale of Eisenberg et al., (Eisenberg et al., J. Mol. Biol., 179:125-142 [1984]). Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

As used herein, "aromatic amino acid or residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom L-His (H) it is sometimes classified as a basic residue, or as an aromatic residue as its side chain includes a heteroaromatic ring, herein histidine is classified as a hydrophilic residue or as a "constrained residue" (see below).

As used herein, "constrained amino acid or residue" refers to an amino acid or residue that has a constrained geometry. Herein, constrained residues include L-Pro (P) and L-His (H). Histidine has a constrained geometry because it has a relatively small imidazole ring. Proline has a constrained geometry because it also has a five membered ring.

As used herein, "non-polar amino acid or residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Gly (G), L-Leu (L), L-Val (V), L-Ile (I), L-Met (M) and L-Ala (A).

As used herein, "aliphatic amino acid or residue" refers to a hydrophobic amino acid or residue having an aliphatic hydrocarbon side chain. Genetically encoded aliphatic amino acids include L-Ala (A), L-Val (V), L-Leu (L) and L-Ile (I). It is noted that cysteine (or "L-Cys" or "[C]") is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present invention, L-Cys (C) is categorized into its own unique group.

As used herein, "small amino acid or residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include L-Ala (A), L-Val (V), L-Cys (C), L-Asn (N), L-Ser (S), L-Thr (T) and L-Asp (D).

As used herein, "hydroxyl-containing amino acid or residue" refers to an amino acid containing a hydroxyl (—OH) moiety. Genetically-encoded hydroxyl-containing amino acids include L-Ser (S) L-Thr (T) and L-Tyr (Y).

As used herein, "amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X40 as compared to SEQ ID NO:2" refers to a difference of the amino acid residue at the polypeptide position corresponding to position 40 of SEQ ID NO:2. Thus, if the reference polypeptide of SEQ ID NO:2 has a histidine at position 40, then a "residue difference at position X40 as compared to SEQ ID NO:2" refers to an amino acid substitution of any residue other than histidine at the position of the polypeptide corresponding to position 40 of SEQ ID NO:2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances, the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X192A/G). In some embodiments, in which there are variants with multiple substitutions, the substitutions are separated by either a semicolon (;) or a slash (/) (e.g., Y17V; I259T; E347K or Y17V/I259T/E347K).

The present invention includes engineered polypeptide sequences comprising one or more amino acid differences that include either/or both conservative and non-conservative amino acid substitutions. The amino acid sequences of the specific recombinant carbonic anhydrase polypeptides included in the Sequence Listing of the present invention include an initiating methionine (M) residue (i.e., M represents residue position 1). The skilled artisan, however, understands that this initiating methionine residue can be removed by biological processing machinery, such as in a host cell or in vitro translation system, to generate a mature protein lacking the initiating methionine residue, but otherwise retaining the enzyme's properties. Consequently, the term "amino acid residue difference relative to SEQ ID NO:2 at position Xn" as used herein may refer to position "Xn" or to the corresponding position (e.g., position (X−1)n) in a reference sequence that has been processed so as to lack the starting methionine.

As used herein, the phrase "conservative amino acid substitutions" refers to the interchangeability of residues having similar side chains, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with a hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively. Exemplary conservative substitutions are provided in Table 1.

TABLE 1

Exemplary Conservative Amino Acid Substitutions

| Residue | Potential Conservative Substitutions |
| --- | --- |
| A, L, V, I | Other aliphatic (A, L, V, I) |
| | Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | Non-polar |

As used herein, the phrase "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification of the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the polypeptide while retaining enzymatic activity and/or retaining the improved properties of an engineered enzyme. Deletions can be directed to the internal portions and/or terminal portions of the polypeptide.

In various embodiments, the deletion can comprise a continuous segment or can be discontinuous.

As used herein, "insertion" refers to modification of the polypeptide by addition of one or more amino acids to the reference polypeptide. In some embodiments, the improved engineered deoxyribose-phosphate aldolase enzymes comprise insertions of one or more amino acids to the naturally occurring deoxyribose-phosphate aldolase polypeptide as well as insertions of one or more amino acids to engineered deoxyribose-phosphate aldolase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The term "amino acid substitution set" or "substitution set" refers to a group of amino acid substitutions in a polypeptide sequence, as compared to a reference sequence. A substitution set can have 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant deoxyribose-phosphate aldolases listed in the Tables provided in the Examples. The term "substitution set" is also used in reference to a group of nucleotide substitutions in a polynucleotide sequence, as compared to a reference sequence.

As used herein, "fragment" refers to a polypeptide that has an amino-terminal and/or carboxy-terminal deletion, but where the remaining amino acid sequence is identical to the corresponding positions in the sequence. Fragments can typically have about 80%, about 90%, about 95%, about 98%, or about 99% of the full-length deoxyribose-phosphate aldolase polypeptide, for example the polypeptide of SEQ ID NO:2. In some embodiments, the fragment is "biologically active" (i.e., it exhibits the same enzymatic activity as the full-length sequence).

As used herein, "isolated polypeptide" refers to a polypeptide that is substantially separated from other contaminants that naturally accompany it (e.g., proteins, lipids, and polynucleotides). The term embraces polypeptides which have been removed or purified from their naturally-occurring environment or expression system (e.g., host cell or in vitro synthesis). The improved deoxyribose-phosphate aldolase enzymes may be present within a cell, present in the cellular medium, or prepared in various forms, such as lysates or isolated preparations. As such, in some embodiments, the engineered deoxyribose-phosphate aldolase polypeptides of the present invention can be an isolated polypeptide.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure engineered deoxyribose-phosphate aldolase polypeptide composition comprises about 60% or more, about 70% or more, about 80% or more, about 90% or more, about 91% or more, about 92% or more, about 93% or more, about 94% or more, about 95% or more, about 96% or more, about 97% or more, about 98% or more, or about 99% of all macromolecular species by mole or % weight present in the composition. Solvent species, small molecules (<500 Daltons), and elemental ion species are not considered macromolecular species. In some embodiments, the isolated improved deoxyribose-phosphate aldolase polypeptide is a substantially pure polypeptide composition.

As used herein, "substantially pure polynucleotide" refers to a composition in which the polynucleotide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure engineered deoxyribose-phosphate aldolase polynucleotide composition comprises about 60% or more, about 70% or more, about 80% or more, about 90% or more, about 91% or more, about 92% or more, about 93% or more, about 94% or more, about 95% or more, about 96% or more, about 97% or more, about 98% or more, or about 99% of all macromolecular species by mole or % weight present in the composition. In some embodiments, the isolated improved deoxyribose-phosphate aldolase polypeptide is a substantially pure polynucleotide composition.

As used herein, "polynucleotide" and "nucleic acid' refer to two or more nucleosides that are covalently linked together. The polynucleotide may be wholly comprised ribonucleosides (i.e., an RNA), wholly comprised of 2' deoxyribonucleotides (i.e., a DNA) or mixtures of ribo- and 2' deoxyribonucleosides. While the nucleosides will typically be linked together via standard phosphodiester linkages, the polynucleotides may include one or more nonstandard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine, and cytosine), it may include one or more modified and/or synthetic nucleobases (e.g., inosine, xanthine, hypoxanthine, etc.). Preferably, such modified or synthetic nucleobases will be encoding nucleobases.

The abbreviations used for the genetically encoding nucleosides are conventional and are as follows: adenosine (A); guanosine (G); cytidine (C); thymidine (T); and uridine (U). Unless specifically delineated, the abbreviated nucleotides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA; with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature Tm as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are known to those of skill in the art.

As used herein, "coding sequence" refers to that portion of a nucleic acid (e.g., a gene) that encodes an amino acid sequence of a protein.

As used herein, "codon optimized" refers to changes in the codons of the polynucleotide encoding a protein to those preferentially used in a particular organism such that the encoded protein is efficiently expressed in the organism of interest. In some embodiments, the polynucleotides encoding the deoxyribose-phosphate aldolase enzymes may be codon optimized for optimal production from the host organism selected for expression. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the deoxyribose-phosphate aldolase enzymes may be codon optimized for optimal production from the host organism selected for expression.

As used herein, "preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, John Peden, University of Nottingham; McInerney, Bioinform., 14:372-73 [1998]; Stenico et al., Nucleic Acids Res., 222:437-46 [1994]; and Wright, Gene 87:23-29 [1990]). Codon usage tables are available for a growing list of organisms (See e.g., Wada et al., Nucleic Acids Res., 20:2111-2118 [1992]; Nakamura et al., Nucl. Acids Res., 28:292 [2000]; Duret, et al., supra; Henaut and Danchin, "*Escherichia coli* and *Salmonella*," Neidhardt, et al. (eds.), ASM Press, Washington D.C., [1996], p. 2047-2066. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Uberbacher, Meth. Enzymol., 266:259-281 [1996]; Tiwari et al., Comput. Appl. Biosci., 13:263-270 [1997]).

As used herein, "control sequence" is defined herein to include all components, which are necessary or advantageous for the expression of a polynucleotide and/or polypeptide of the present invention. Each control sequence may be native or foreign to the polynucleotide of interest. Such control sequences include, but are not limited to, a leader, polyadenylation sequence, propeptide sequence, promoter, signal peptide sequence, and transcription terminator.

As used herein, "operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

As used herein, "promoter sequence" refers to a nucleic acid sequence that is recognized by a host cell for expression of a polynucleotide of interest, such as a coding sequence. The control sequence may comprise an appropriate promoter sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

As used herein, "naturally occurring" and "wild-type" refers to the form found in nature. For example, a naturally occurring or wild-type polypeptide or polynucleotide sequence is a sequence present in an organism that can be isolated from a source in nature and which has not been intentionally modified by human manipulation.

As used herein, "non-naturally occurring," "engineered," "variant," and "recombinant" when used in the present invention with reference to (e.g., a cell, nucleic acid, or polypeptide), refers to a material, or a material corresponding to the natural or native form of the material, that has been modified in a manner that would not otherwise exist in nature. In some embodiments the material is identical to naturally occurring material, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

As used herein, "percentage of sequence identity," "percent identity," and "percent identical" refer to comparisons between polynucleotide sequences or polypeptide sequences, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Determination of optimal alignment and percent sequence identity is performed using the BLAST and BLAST 2.0 algorithms (See e.g., Altschul et al., J. Mol. Biol. 215: 403-410 [1990]; and Altschul et al., Nucl. Acids Res., 25: 3389-3402 [1977]). Software for performing BLAST analyses is publicly available through the National Center for Biotechnology Information website.

Briefly, the BLAST analyses involve first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See e.g., Henikoff and Henikoff, Proc. Natl. Acad. Sci. USA 89:10915 [1989]).

Numerous other algorithms are available and known in the art that function similarly to BLAST in providing percent identity for two sequences. Optimal alignment of sequences for comparison can be conducted using any suitable method known in the art (e.g., by the local homology algorithm of Smith and Waterman, Adv. Appl. Math., 2:482 [1981]; by the homology alignment algorithm of Needleman and Wunsch, J. Mol. Biol., 48:443 [1970]; by the search for similarity method of Pearson and Lipman, Proc. Natl. Acad. Sci. USA 85:2444 [1988]; and/or by computerized implementations of these algorithms [GAP, BESTFIT, FASTA, and TFASTA in the GCG Wisconsin Software Package]), or by visual inspection, using methods commonly known in the art. Additionally, determination of sequence alignment and percent sequence identity can employ the BESTFIT or GAP programs in the GCG Wisconsin Software package (Accelrys, Madison Wis.), using the default parameters provided.

As used herein, "substantial identity" refers to a polynucleotide or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some preferred embodiments, residue positions that are not identical differ by conservative amino acid substitutions.

As used herein, "reference sequence" refers to a defined sequence to which another sequence is compared. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a comparison window to identify and compare local regions of sequence similarity. The term "reference sequence" is not intended to be limited to wild-type sequences, and can include engineered or altered sequences. For example, in some embodiments, a "reference sequence" can be a previously engineered or altered amino acid sequence.

As used herein, "comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered deoxyribose-phosphate aldolase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned. As used herein, a reference to a residue position, such as "Xn" as further described below, is to be construed as referring to "a residue corresponding to", unless specifically denoted otherwise. Thus, for example, "X94" refers to any amino acid at position 94 in a polypeptide sequence.

As used herein, when used in reference to a nucleic acid or polypeptide, the term "heterologous" refers to a sequence that is not normally expressed and secreted by an organism (e.g., a wild-type organism). In some embodiments, the term encompasses a sequence that comprises two or more subsequences which are not found in the same relationship to each other as normally found in nature, or is recombinantly engineered so that its level of expression, or physical relationship to other nucleic acids or other molecules in a cell, or structure, is not normally found in nature. For instance, a heterologous nucleic acid is typically recombinantly produced, having two or more sequences from unrelated genes arranged in a manner not found in nature (e.g., a nucleic acid open reading frame (ORF) of the invention operatively linked to a promoter sequence inserted into an expression cassette, such as a vector). In some embodiments, "heterologous polynucleotide" refers to any polynucleotide that is introduced into a host cell by laboratory techniques, and includes polynucleotides that are removed from a host cell, subjected to laboratory manipulation, and then reintroduced into a host cell.

As used herein, "improved enzyme property" refers to a deoxyribose-phosphate aldolase that exhibits an improvement in any enzyme property as compared to a reference deoxyribose-phosphate aldolase. For the engineered deoxyribose-phosphate aldolase polypeptides described herein, the comparison is generally made to the wild-type deoxyribose-phosphate aldolase enzyme, although in some embodiments, the reference deoxyribose-phosphate aldolase can be another improved engineered deoxyribose-phosphate aldolase. Enzyme properties for which improvement is desirable include, but are not limited to, enzymatic activity (which can be expressed in terms of percent conversion of the substrate at a specified reaction time using a specified amount of deoxyribose-phosphate aldolase), chemoselectivity, thermal stability, solvent stability, pH activity profile, refractoriness to inhibitors (e.g., product inhibition), stereospecificity, and stereoselectivity (including enantioselectivity).

As used herein, "increased enzymatic activity" refers to an improved property of the engineered deoxyribose-phosphate aldolase polypeptides, which can be represented by an increase in specific activity (e.g., product produced/time/weight protein) or an increase in percent conversion of the substrate to the product (e.g., percent conversion of starting amount of substrate to product in a specified time period using a specified amount of deoxyribose-phosphate aldolase) as compared to the reference deoxyribose-phosphate aldolase enzyme. Exemplary methods to determine enzyme activity are provided in the Examples. Any property relating to enzyme activity may be affected, including the classical enzyme properties of Km, Vmax or kcat, changes of which can lead to increased enzymatic activity. Improvements in enzyme activity can be from about 1.5 times the enzymatic activity of the corresponding wild-type deoxyribose-phosphate aldolase enzyme, to as much as 2 times. 5 times, 10 times, 20 times, 25 times, 50 times, 75 times, 100 times, or more enzymatic activity than the naturally occurring deoxyribose-phosphate aldolase or another engineered deoxyribose-phosphate aldolase from which the deoxyribose-phosphate aldolase polypeptides were derived. In some embodiments, the engineered deoxyribose-phosphate aldolase enzyme exhibits improved enzymatic activity in the range of 1.5 to 50 times, 1.5 to 100 times greater than that of the parent deoxyribose-phosphate aldolase enzyme. It is understood by the skilled artisan that the activity of any enzyme is diffusion limited such that the catalytic turnover rate cannot exceed the diffusion rate of the substrate. The theoretical maximum of the diffusion limit, or kcat/Km, is generally about 108 to 109 (M−1 s−1). Hence, any improvements in the enzyme activity of the deoxyribose-phosphate aldolase will have an upper limit related to the diffusion rate of the substrates acted on by the deoxyribose-phosphate aldolase enzyme. Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

As used herein, "increased enzymatic activity" and "increased activity" refer to an improved property of an engineered enzyme, which can be represented by an increase in specific activity (e.g., product produced/time/weight protein) or an increase in percent conversion of the substrate to the product (e.g., percent conversion of starting amount of substrate to product in a specified time period using a specified amount of deoxyribose-phosphate aldolase) as compared to a reference enzyme as described herein. Any property relating to enzyme activity may be affected, including the classical enzyme properties of Km, Vmax or kcat, changes of which can lead to increased enzymatic activity. Comparisons of enzyme activities are made using a defined preparation of enzyme, a defined assay under a set condition, and one or more defined substrates, as further described in detail herein. Generally, when enzymes in cell lysates are compared, the numbers of cells and the amount of protein assayed are determined as well as use of identical expression systems and identical host cells to minimize variations in amount of enzyme produced by the host cells and present in the lysates.

As used herein, "conversion" refers to the enzymatic transformation of a substrate to the corresponding product.

As used herein "percent conversion" refers to the percent of the substrate that is converted to the product within a period of time under specified conditions. Thus, for example, the "enzymatic activity" or "activity" of a deoxyribose-phosphate aldolase polypeptide can be expressed as "percent conversion" of the substrate to the product.

As used herein, "chemoselectivity" refers to the preferential formation in a chemical or enzymatic reaction of one product over another.

As used herein, "thermostable" and "thermal stable" are used interchangeably to refer to a polypeptide that is resistant to inactivation when exposed to a set of temperature conditions (e.g., 40-80° C.) for a period of time (e.g., 0.5-24 hrs) compared to the untreated enzyme, thus retaining a certain level of residual activity (e.g., more than 60% to 80%) after exposure to elevated temperatures.

As used herein, "solvent stable" refers to the ability of a polypeptide to maintain similar activity (e.g., more than 60% to 80%) after exposure to varying concentrations (e.g., 5-99%) of solvent (e.g., isopropyl alcohol, tetrahydrofuran, 2-methyltetrahydrofuran, acetone, toluene, butylacetate, methyl tert-butylether, etc.) for a period of time (e.g., 0.5-24 hrs) compared to the untreated enzyme.

As used herein, "pH stable" refers to a deoxyribose-phosphate aldolase polypeptide that maintains similar activity (e.g., more than 60% to 80%) after exposure to high or low pH (e.g., 4.5-6 or 8 to 12) for a period of time (e.g., 0.5-24 hrs) compared to the untreated enzyme.

As used herein, "thermo- and solvent stable" refers to a deoxyribose-phosphate aldolase polypeptide that is both thermostable and solvent stable.

As used herein, "suitable reaction conditions" refer to those conditions in the biocatalytic reaction solution (e.g., ranges of enzyme loading, substrate loading, temperature, pH, buffers, co-solvents, etc.) under which a deoxyribose-phosphate aldolase polypeptide of the present invention is capable of acting. Exemplary "suitable reaction conditions" are provided in the present invention and illustrated by the Examples.

As used herein, "loading," such as in "compound loading," and "enzyme loading," refers to the concentration or amount of a component in a reaction mixture at the start of the reaction.

As used herein, "substrate" in the context of a biocatalyst mediated process refers to the compound or molecule acted on by the biocatalyst.

As used herein "product" in the context of a biocatalyst mediated process refers to the compound or molecule resulting from the action of the biocatalyst.

As used herein, "equilibration" as used herein refers to the process resulting in a steady state concentration of chemical species in a chemical or enzymatic reaction (e.g., interconversion of two species A and B), including interconversion of stereoisomers, as determined by the forward rate constant and the reverse rate constant of the chemical or enzymatic reaction.

"Dexyribose-phosphate aldolase" and "DERA" are used interchangeably herein to refer to a polypeptide in a family of lyases that reversibly cleave or create carbon-carbon bonds. Deoxyribose-phosphate aldolases as used herein include naturally occurring (wild type) deoxyribose-phosphate aldolase as well as non-naturally occurring engineered polypeptides generated by human manipulation. The wild-type deoxyribose-phosphate aldolase catalyzes the reversible reaction of 2-deoxy-D-ribose 5-phosphate into D-glyceraldehyde 3-phosphate and acetaldehyde.

"R-2-ethynyl-glyceraldehyde" and "EGA" are used interchangeably herein to refer to the substrate for the aldolase reaction.

"(4S,5R)-5-ethynyl-deoxyribose" and "EDR" are used interchangeably herein to refer to the product with the desired stereochemistry.

"Cofactor," as used herein, refers to a non-protein compound that operates in combination with an enzyme in catalyzing a reaction.

"Optional" or "optionally" means that the subsequently described event or circumstance may or may not occur, and that the description includes instances where said event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

"Protecting group" refers to a group of atoms that mask, reduce or prevent the reactivity of the functional group when attached to a reactive functional group in a molecule. Typically, a protecting group may be selectively removed as desired during the course of a synthesis. Examples of protecting groups are known in the art (e.g., Wuts and Greene, "Greene's Protective Groups in Organic Synthesis," 4th Ed., Wiley Interscience [2006], and Harrison et al., Compendium of Synthetic Organic Methods, Vols. 1-8, John Wiley & Sons, NY [1971-1976]. Functional groups that can have a protecting group include, but are not limited to, hydroxy, amino, and carboxy groups. Representative amino protecting groups include, but are not limited to, formyl, acetyl, trifluoroacetyl, benzyl, benzyloxycarbonyl ("CBZ"), tert-butoxycarbonyl ("Boc"), trimethylsilyl ("TMS"), 2-trimethylsilyl-ethanesulfonyl ("SES"), trityl and substituted trityl groups, allyloxycarbonyl, 9-fluorenylmethyloxycarbonyl ("FMOC"), nitro-veratryloxycarbonyl ("NVOC") and the like. Representative hydroxyl protecting groups include, but are not limited to, those where the hydroxyl group is either acylated (e.g., methyl and ethyl esters, acetate or propionate groups or glycol esters) or alkylated such as benzyl and trityl ethers, as well as alkyl ethers, tetrahydropyranyl ethers, trialkylsilyl ethers (e.g., TMS or TIPPS groups) and allyl ethers. Other protecting groups can be found in the references noted herein.

"Leaving group" generally refers to any atom or moiety that is capable of being displaced by another atom or moiety in a chemical reaction. More specifically, a leaving group refers to an atom or moiety that is readily displaced and substituted by a nucleophile (e.g., an amine, a thiol, an alcohol, or cyanide). Such leaving groups are well known and include carboxylates, N-hydroxysuccinimide ("NHS"), N-hydroxybenzotriazole, a halogen (fluorine, chlorine, bromine, or iodine), and alkyloxy groups. Non-limiting characteristics and examples of leaving groups are known in the art and described in various chemistry texts.

Engineered Deoxyribose-Phosphate Aldolase Polypeptides

The present invention provides engineered polypeptides having deoxyribose-phosphate aldolase activity (also referred to herein as "engineered deoxyribose-phosphate aldolase polypeptides"). Further, the present invention provides polynucleotides encoding the engineered polypeptides, associated vectors and host cells comprising the polynucleotides, methods for making the engineered polypeptides, and methods for using the engineered polypeptides, including suitable reaction conditions.

The engineered polypeptides of the present invention are non-naturally occurring deoxyribose-phosphate aldolases engineered to have improved enzyme properties (such as increased stereoselectivity) as compared to the wild-type deoxyribose-phosphate aldolase polypeptide of *Shewanella halifaxensis* (UniProt Acc. No. B0TQ91; SEQ ID NO:2), which was used as the starting backbone sequence for the directed evolution of the engineered polypeptides of the present invention.

The engineered deoxyribose-phosphate aldolase polypeptides of the present invention were generated by directed evolution of SEQ ID NO:2 for efficient conversion of EGA and acetaldehyde to (4S,5R)-5-ethynyl-deoxyribose (EDR). In some embodiments, the EDR is diastereopure (i.e., ≥99% DE). In some embodiments, the conversion is conducted with enantiopure EGA or diastereopure (≥99% DE). In some additional embodiments, the conversion is conducted with enatiopure (≥99% EE) EDR from racemic EGA. In some further embodiments, these properties are used in one or more combinations; it is not intended that the present invention be limited to any specific reagent purity level.

The present invention provides numerous exemplary engineered deoxyribose-phosphate aldolase polypeptides comprising amino acid sequences of the even-numbered sequence identifiers SEQ ID NO:2-478. These exemplary engineered deoxyribose-phosphate aldolase polypeptides comprise amino acid sequences that include one or more of the following residue differences as compared to a reference sequence (e.g., SEQ ID NO: 2, 6, and/or 466).

In some cases, the exemplary engineered polypeptides have an amino acid sequence that further comprises one or more residue differences as compared to a reference sequence (e.g., SEQ ID NO: 2, 6, and/or 466). In some cases, the exemplary engineered polypeptides have an amino acid sequence that further comprises one or more residue differences as compared to a reference sequence (e.g., SEQ ID NO: 2, 6, and/or 466).

In some embodiments, the engineered polypeptide comprises an amino acid sequence that is at least about 80%, 85%, 86%, 87%, 88%, 89%, 90%, 91%, 92%, 93%, 94%, 95%, 96%, 97%, 98%, 99%, or more, identical to a reference sequence selected from SEQ ID NO: 2, 6, and/or 466, where the polypeptide has deoxyribose-phosphate aldolase activity and one or more of the improved properties as described herein, for example the ability to convert EGA and acetaldehyde to EDR, with increased activity as compared to a reference sequence (e.g., the polypeptide of SEQ ID NO: 2, 6, and/or 466). In some embodiments, the reference sequence is SEQ ID NO: 2. In some embodiments, the reference sequence is SEQ ID NO: 6. In some embodiments, the reference sequence is SEQ ID NO: 466.

In some embodiments, the engineered deoxyribose-phosphate aldolase polypeptide comprising an amino acid sequence has one or more amino acid residue differences as compared to SEQ ID NO: 2, 6, and/or 466. In some embodiments, the present invention provides an engineered polypeptide having deoxyribose-phosphate aldolase activity comprising an amino acid sequence having at least 80%, 85%, 86%, 87%, 88%, 89%, 90%, 91%, 92%, 93%, 94%, 95%, 96%, 97%, 98%, 99%, or more sequence identity to reference sequence of SEQ ID NO: 2, 6, and/or 466, and (a) at least one amino acid residue difference selected from those substitutions provided herein (See e.g., Tables 3.1, 4.1 and 6.1).

In some embodiments, the present invention provides an engineered deoxyribose-phosphate aldolase polypeptide comprising an amino acid sequence that has one or more amino acid residue differences as compared to SEQ ID NO: 2 at positions selected from S2C, S2R, S2W, K6H, K6W, K6Y, Q9R, Q10R/C47M/D66P/S141T/A145K/L156I, Q10R/C47M/L88A/L156I, S13I, S13L, S13Q, S13R, E31L, I46V, C47M, C47M/I134L/S141T/F212Y, C47V, D66I, D66L, D66P, D66P/L88A/E112A/I134L/S141T/V143E/A145K/F212Y, D66S, D66T, A71V, T72C, L88R, L88T, V94K, V94L, V94M, D102E, V104T, E112H, E112K, E112L, E112M, E112R, T116G, T116P, T133I/A173V/K204T/S235D/S236H, T133L, T133M, I134L, I134V, A145C, A145R, A145V/A173R, P147A, P147K, P147S, A173P, A173T, M184I, M184V, S189A, S189R, F197C, F197M, V203I, K204T, A207G, T226S, S235D, S235D/S236R, S235T, S236C, and S236D, wherein the positions are numbered with reference to SEQ ID NO: 2. In some embodiments, the amino acid differences comprise the substitution(s) S2C, S2R, S2W, K6H, K6W, K6Y, Q9R, Q10R/C47M/D66P/S141T/A145K/L156I, Q10R/C47M/L88A/L156I, S13I, S13L, S13Q, S13R, E31L, I46V, C47M, C47M/I134L/S141T/F212Y, C47V, D66I, D66L, D66P, D66P/L88A/E112A/I134L/S141T/V143E/A145K/F212Y, D66S, D66T, A71V, T72C, L88R, L88T, V94K, V94L, V94M, D102E, V104T, E112H, E112K, E112L, E112M, E112R, T116G, T116P, T133I/A173V/K204T/S235D/S236H, T133L, T133M, I134L, I134V, A145C, A145R, A145V/A173R, P147A, P147K, P147S, A173P, A173T, M184I, M184V, S189A, S189R, F197C, F197M, V203I, K204T, A207G, T226S, S235D, S235D/S236R, S235T, S236C, and S236D, wherein the positions are numbered with reference to SEQ ID NO: 2.

In some embodiments, the present invention provides an engineered deoxyribose-phosphate aldolase polypeptide comprising an amino acid sequence that has one or more amino acid residue differences as compared to SEQ ID NO: 6 at positions selected from 2, 2/6/10/66/88/102/184/235/236, 2/6/102/141/203/235, 2/10/102/235/236, 2/47/66/71/141/184/203/235/236, 2/47/71/88/203/235/236, 2/47/71/141/197/235/236, 2/88/141/235/236, 2/203/235/236, 5, 6/203/235/236, 9, 10/47/66/184/197/236, 10/47/66/235/236, 10/47/71/184/203/235/236, 13, 13/46, 13/46/66/94, 13/46/66/94/184/204, 13/46/66/133/134/184, 13/46/66/184, 13/46/112/134/184, 13/46/133/184, 13/66/94, 13/66/94/184, 13/66/112/133/134/184/204, 13/66/112/133/134/204, 13/66/112/184, 13/66/133/134/184/204, 13/66/184/204, 13/94/133/184, 13/94/184, 13/94/184/204, 13/133/134/184, 13/133/134/204, 13/134/204, 13/184, 27, 40, 46/66/94/112, 46/66/112/133/134/184, 46/66/133/134, 46/66/133/184/197, 46/66/133/197, 46/66/134/184/197/204, 46/66/184, 46/112/133, 46/112/133/134/204, 46/133/204, 46/197/204, 47/66/71/88/203/235/236, 47/66/71/141/184, 47/66/88/184/235, 47/66/88/203/235/236, 47/66/141/235/236, 47/66/184/197/203/235/236, 47/66/184/197/236, 47/71/88/184/203/235, 47/71/88/184/203/236, 47/71/141/184/203/235, 47/71/184, 47/71/184/197/236, 47/71/184/235, 47/71/184/236, 47/88/102/141/235/236, 47/88/203/235/236, 47/88/235/236, 47/102/184/197/235/236, 47/102/203/235/236, 47/141/184, 47/141/184/236, 47/184/236, 47/203/235, 47/203/235/236, 47/203/236, 47/235/236, 62, 66, 66/88/102/184/197/203/235/236, 66/88/197, 66/88/235, 66/88/235/236, 66/94, 66/94/112/133/184, 66/94/112/184/204, 66/102/184/235/236, 66/112/133/134/197, 66/112/133/197, 66/112/134/197, 66/112/184, 66/133/184, 66/133/197, 66/184, 66/197/203/235, 84, 88, 88/102/141/184/235/236, 88/184, 88/184/197/203/235/236, 88/184/197/235/236, 88/184/203/235, 88/184/236, 88/197/235/236, 88/236, 94/112/184/197, 94/133/184, 96, 102/141/203, 102/184/203/236, 102/184/236, 102/197/235, 112, 112/133/134, 112/133/184/204, 112/134/197, 114, 115, 120, 127, 132, 133, 133/134/184, 141/184/203/235/236, 141/184/235, 141/197, 141/203/235/236, 141/236, 146, 148, 184, 184/203, 184/203/235, 184/203/236, 184/235/236, 184/236, 197/235, 203/235/236, 203/236, 204, 218, 235, 235/236, and 236, wherein the positions are numbered with reference to SEQ ID NO: 6. In some embodiments, the amino acid differences comprise the substitution(s) S2C/M47V/P66L/A71V/T141S/M184I/V203I/S235T/S236D, S2C/M47V/A71V/L88A/V203I/S235T/S236D, S2C/M47V/A71V/T141S/F197M/S235T/S236D, S2N, S2R/K6H/R10Q/P66L/L88A/D102E/M184I/S235T/S236D, S2R/K6H/D102E/T141S/V203I/S235T, S2R/R10Q/D102E/S235T/S236D, S2R/L88A/T141S/S235D/S236D, S2R/V203I/S235T/S236D, K5R, K6H/V203I/S235T/S236D, Q9K, Q9L, R10Q/M47V/P66L/M184I/F197M/S236D, R10Q/M47V/P66L/S235T/S236D, R10Q/M47V/A71V/M184I/V203I/S235T/S236D, S13I, S13I/I46V, S13I/I46V/P66S/V94L, S13I/I46V/P66S/V94L/M184V/K204T, S13I/I46V/P66S/T133L/I134L/M184V, S13I/I46V/P66S/M184V, S13I/I46V/E112K/I134L/M184V, S13I/I46V/T133L/M184V, S13I/I46V/T133M/M184V, S13I/P66S/V94L, S13I/P66S/V94L/M184V, S13I/P66S/E112K/T133M/ I134L/M184V/K204T, S13I/P66S/E112K/T133M/I134L/ K204T, S13I/P66S/E112M/M184V, S13I/P66S/T133M/ I134L/M184V/K204T, S13I/P66S/M184V/K204T, S13I/ V94L/T133M/M184V, S13I/V94L/M184V, S13I/V94L/ M184V/K204T, S13I/T133M/I134L/M184V, S13I/T133M/ I134L/K204T, S13I/I134L/K204T, S13I/M184V, S13L, S13T, Q27R, A40W, I46V/P66S/V94L/E112K, I46V/P66S/ E112K/T133L/I134L/M184V, I46V/P66S/T133L/I134L, I46V/P66S/T133L/M184V/F197C, I46V/P66S/T133M/ F197C, I46V/P66S/I134L/M184V/F197C/K204T, I46V/ P66S/M184V, I46V/E112K/T133L/I134L/K204T, I46V/ E112M/T133L, I46V/T133M/K204T, I46V/F197C/K204T, M47V/P66L/A71V/L88A/V203I/S235T/S236D, M47V/ P66L/A71V/T141S/M184I, M47V/P66L/L88A/M184I/ S235T, M47V/P66L/L88A/V203I/S235T/S236D, M47V/ P66L/T141S/S235T/S236D, M47V/P66L/M184I/F197M/ V203I/S235T/S236D, M47V/P66L/M184I/F197M/S236D, M47V/A71V/L88A/M184I/V203I/S235D, M47V/A71V/ L88A/M184I/V203I/S236D, M47V/A71V/T141S/M184I/ V203I/S235D, M47V/A71V/M184I, M47V/A71V/M184I/ F197M/S236D, M47V/A71V/M184I/S235T, M47V/A71V/ M184I/S236D, M47V/L88A/D102E/T141S/S235T/S236D, M47V/L88AN203I/S235D/S236D, M47V/L88A/S235T/ S236D, M47V/D102E/M184I/F197M/5235T/S236D, M47V/D102E/V203I/S235T/5236D, M47V/T141S/M184I, M47V/T141S/M184I/S236D, M47V/M184I/S236D, M47V/V203I/S235D, M47V/V203I/S235T/S236D, M47V/ V203I/S236D, M47V/S235T/S236D, E62L, P66A, P66C, P66H, P66L/L88A/D102E/M184I/F197M/V203I/S235T/ S236D, P66L/L88A/F197M, P66L/L88A/S235D, P66L/ L88A/S235T/S236D, P66L/D102E/M184I/S235D/S236D, P66L/M184I, P66L/F197M/V203I/S235D, P66S/V94L, P66S/V94L/E112K/T133L/M184V, P66S/V94L/E112K/ M184V/K204T, P66S/V94L/E112M/T133M/M184V, P66S/ E112K/T133L/I134L/F197C, P66S/E112K/I134L/F197C, P66S/E112K/M184V, P66S/E112M/T133L/F197C, P66S/ T133L/F197C, P66S/T133M/M184V, P66S/M184V, A84C, A84L, L88A/D102E/T141S/M184I/S235T/S236D, L88A/ M184I, L88A/M184I/F197M/V203I/S235T/S236D, L88A/ M184I/F197M/S235D/S236D, L88A/M184I/V203I/S235D, L88A/M184I/S236D, L88A/F197M/S235T/S236D, L88A/ S236D, L88H, L88V, V94L/E112M/M184V/F197C, V94L/ T133L/M184V, Y96L, D102E/T141S/V203I, D102E/ M184I/V203I/S236D, D102E/M184I/S236D, D102E/ F197M/S235D, E112C, E112K/T133L/M184V/K204T, E112K/T133M/I134L, E112K/I134L/F197C, E112N, N114R, E115D, E115V, E120M, E120R, E127G, E127H, E127L, E127R, E127T, E127V, D132L, T133G, T133H, T133L, T133M/I134L/M184V, T133R, T141S/M184I/ V203I/S235T/S236D, T141S/M184I/S235D, T141S/ F197M, T141S/V203I/S235D/S236D, T141S/S236D, D146Q, A148G, A148L, M184I/V203I, M184I/V203I/ S235D, M184I/V203I/S236D, M184I/S235T/S236D, M184I/S236D, M184V, F197M/S235D, V203I/S235T/ S236D, V203I/S236D, K204T, R218S, S235D/S236D, S235T, S235T/S236D, and S236D, wherein the positions are numbered with reference to SEQ ID NO: 6.

In some embodiments, the engineered polypeptides having deoxyribose-phosphate aldolase activity are capable of converting EGA and acetaldehyde to EDR, with increased tolerance for the presence of the substrate (e.g., acetaldehyde) relative to the substrate tolerance of a reference polypeptide (e.g., SEQ ID NO: 2, 6, and/or 466), under suitable reaction conditions. Accordingly, in some embodiments the engineered polypeptides are capable of converting EGA and acetaldehyde to EDR at a substrate loading concentration of at least about 1 g/L, 5 g/L, 10 g/L, 20 g/L, about 30 g/L, about 40 g/L, about 50 g/L, about 70 g/L, about 75 g/L, about 100 g/L, with a percent conversion of at least about 40%, at least about 50%, at least about 60%, at least about 70%, at least about 80%, at least about 90%, at least about 91%, at least about 92%, at least about 94%, at least about 94%, at least about 95%, at least about 96%, at least about 97%, at least about 98%, or at least about 99%, in a reaction time of about 72 h, about 48 h, about 36 h, about 24 h, or even shorter length of time, under suitable reaction conditions.

Some suitable reaction conditions under which the above-described improved properties of the engineered polypeptides can be determined with respect concentrations or amounts of polypeptide, substrate, buffer, pH, and/or conditions including temperature and reaction time are provided herein. In some embodiments, the suitable reaction conditions comprise the assay conditions described below and in the Examples.

As will be apparent to the skilled artisan, the foregoing residue positions and the specific amino acid residues for each residue position can be used individually or in various combinations to synthesize deoxyribose-phosphate aldolase polypeptides having desired improved properties, including, among others, enzyme activity, substrate/product preference, stereoselectivity, substrate/product tolerance, and stability under various conditions, such as increased temperature, solvent, and/or pH.

In some embodiments, the present invention also provides engineered deoxyribose-phosphate aldolase polypeptides that comprise a fragment of any of the engineered deoxyribose-phosphate aldolase polypeptides described herein that retains the functional deoxyribose-phosphate aldolase activity and/or improved property of that engineered deoxyribose-phosphate aldolase polypeptide. Accordingly, in some embodiments, the present invention provides a polypeptide fragment having deoxyribose-phosphate aldolase activity (e.g., capable of converting EGA and acetaldehyde to EDR under suitable reaction conditions), wherein the fragment comprises at least about 80%, 90%, 95%, 98%, or 99% of a full-length amino acid sequence of an engineered polypeptide of the present invention, such as an exemplary engineered polypeptide of having the even-numbered sequence identifiers of SEQ ID NO: 2-478.

In some embodiments, the engineered deoxyribose-phosphate aldolase polypeptide of the invention comprises an amino acid sequence comprising a deletion as compared to any one of the engineered deoxyribose-phosphate aldolase polypeptide sequences described herein, such as the exemplary engineered polypeptide sequences having the even-numbered sequence identifiers of SEQ ID NO: 2-478. Thus, for each and every embodiment of the engineered deoxyribose-phosphate aldolase polypeptides of the invention, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids, or up to 30% of the total number of amino acids of the deoxyribose-phosphate aldolase polypeptides, where the associated functional activity and/or improved properties of the engineered deoxyribose-phosphate aldolase described herein is maintained. In some embodiments, the deletions can comprise, 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, 1-50, 1-55, or 1-60 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, or 60 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, 25 or 30 amino acid residues.

In some embodiments, the present invention provides an engineered deoxyribose-phosphate aldolase polypeptide having an amino acid sequence comprising an insertion as compared to any one of the engineered deoxyribose-phosphate aldolase polypeptide sequences described herein, such as the exemplary engineered polypeptide sequences having the even-numbered sequence identifiers of SEQ ID NO: 2-478. Thus, for each and every embodiment of the deoxyribose-phosphate aldolase polypeptides of the invention, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, where the associated functional activity and/or improved properties of the engineered deoxyribose-phosphate aldolase described herein is maintained. The insertions can be to amino or carboxy terminus, or internal portions of the deoxyribose-phosphate aldolase polypeptide.

In some embodiments, the polypeptides of the present invention are in the form of fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

The engineered deoxyribose-phosphate aldolase polypeptides described herein are not restricted to the genetically encoded amino acids. Thus, in addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-stereoisomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutamic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art. These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (nitropyridinesulfenyl), Glu(δ-benzylester), Gln(xanthyl), Asn(N-δ-xanthyl), His(bom), His (benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having deoxyribose-phosphate aldolase activity are bound or immobilized on the solid support such that they retain their improved activity, enantioselectivity, stereoselectivity, and/or other improved properties relative to a reference polypeptide (e.g., SEQ ID NO: 2, 6, and/or 466). In such embodiments, the immobilized polypeptides can facilitate the biocatalytic conversion of the substrate compound to the desired product, and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the engineered deoxyribose-phosphate aldolase polypeptides of the present invention can be carried out using the same deoxyribose-phosphate aldolase polypeptides bound or immobilized on a solid support.

The engineered deoxyribose-phosphate aldolase polypeptide can be bound non-covalently or covalently. Various methods for conjugation and immobilization of enzymes to solid supports (e.g., resins, membranes, beads, glass, etc.) are well known in the art. In particular, PCT publication WO2012/177527 A1 discloses methods of preparing the immobilized polypeptides, in which the polypeptide is physically attached to a resin by either hydrophobic interactions or covalent bonds, and is stable in a solvent system that comprises at least up to 100% organic solvent. Other methods for conjugation and immobilization of enzymes to solid supports (e.g., resins, membranes, beads, glass, etc.) are well known in the art (See e.g., Yi et al., Proc. Biochem., 42: 895-898 [2007]; Martin et al., Appl. Microbiol. Biotechnol., 76: 843-851 [2007]; Koszelewski et al., J. Mol. Cat. B: Enz., 63: 39-44 [2010]; Truppo et al., Org. Proc. Res. Develop., published online: dx.doi.org/10.1021/op200157c; and Mateo et al., Biotechnol. Prog., 18:629-34 [2002], etc.).

Solid supports useful for immobilizing the engineered deoxyribose-phosphate aldolase polypeptides of the present invention include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered deoxyribose-phosphate aldolases of the present invention include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the engineered deoxyribose-phosphate aldolase polypeptides are provided in the form of an array in which the polypeptides are arranged in positionally distinct locations. In some embodiments, the positionally distinct locations are wells in a solid support such as a 96-well plate. A plurality of supports can be configured on an array at various locations, addressable for robotic delivery of reagents, or by detection methods and/or instruments. Such arrays can be used to test a variety of substrate compounds for conversion by the polypeptides.

In some embodiments, the engineered polypeptides described herein are provided in the form of kits. The polypeptides in the kits may be present individually or as a plurality of polypeptides. The kits can further include reagents for carrying out enzymatic reactions, substrates for assessing the activity of polypeptides, as well as reagents for detecting the products. The kits can also include reagent dispensers and instructions for use of the kits. In some embodiments, the kits of the present invention include arrays comprising a plurality of different engineered deoxyribose-phosphate aldolase polypeptides at different addressable position, wherein the different polypeptides are different variants of a reference sequence each having at least one different improved enzyme property. Such arrays compris-ing a plurality of engineered polypeptides and methods of their use are known (See e.g., WO2009/008908A2).

Polynucleotides, Control Sequences, Expression Vectors, and Host Cells Useful for Preparing Engineered Deoxyribose-Phosphate Aldolase Polypeptides In another aspect, the present invention provides polynucleotides encoding the engineered polypeptides having deoxyribose-phosphate aldolase activity described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered deoxyribose-phosphate aldolase can be introduced into appropriate host cells to express the corresponding engineered deoxyribose-phosphate aldolase polypeptide.

In some embodiments, the isolated polynucleotide encoding an improved deoxyribose-phosphate aldolase polypeptide is manipulated in a variety of ways to provide for improved activity and/or expression of the polypeptide. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

Those of ordinary skill in the art understand that due to the degeneracy of the genetic code, a multitude of nucleotide sequences encoding variant deoxyribose-phosphate aldolase acylase polypeptides of the present invention exist. For example, the codons AGA, AGG, CGA, CGC, CGG, and CGU all encode the amino acid arginine. Thus, at every position in the nucleic acids of the invention where an arginine is specified by a codon, the codon can be altered to any of the corresponding codons described above without altering the encoded polypeptide. It is understood that "U" in an RNA sequence corresponds to "T" in a DNA sequence. The invention contemplates and provides each and every possible variation of nucleic acid sequence encoding a polypeptide of the invention that could be made by selecting combinations based on possible codon choices.

As indicated above, DNA sequence encoding a deoxyribose-phosphate aldolase may also be designed for high codon usage bias codons (codons that are used at higher frequency in the protein coding regions than other codons that code for the same amino acid). The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. A codon whose frequency increases with the level of gene expression is typically an optimal codon for expression. In particular, a DNA sequence can be optimized for expression in a particular host organism. A variety of methods are well-known in the art for determining the codon frequency (e.g., codon usage, relative synonymous codon usage) and codon preference in specific organisms, including multivariate analysis (e.g., using cluster analysis or correspondence analysis,) and the effective number of codons used in a gene. The data source for obtaining codon usage may rely on any available nucleotide sequence capable of coding for a protein. These data sets include nucleic acid sequences actually known to encode expressed proteins (e.g., complete protein coding sequences- CDS), expressed sequence tags (ESTs), or predicted coding regions of genomic sequences, as is well-known in the art. Polynucleotides encoding variant deoxyribose-phosphate aldolases can be prepared using any suitable methods known in the art. Typically, oligonucleotides are individually synthesized, then joined (e.g., by enzymatic or chemical ligation methods, or polymerase-mediated methods) to form essentially any desired continuous sequence. In some embodiments, polynucleotides of the present invention are prepared by chemical synthesis using, any suitable methods known in the art, including but not limited to automated synthetic methods. For example, in the phosphoramidite method, oligonucleotides are synthesized (e.g., in an automatic DNA synthesizer), purified, annealed, ligated and cloned in appropriate vectors. In some embodiments, double stranded DNA fragments are then obtained either by synthesizing the complementary strand and annealing the strands together under appropriate conditions, or by adding the complementary strand using DNA polymerase with an appropriate primer sequence. There are numerous general and standard texts that provide methods useful in the present invention are well known to those skilled in the art.

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the polynucleotide encodes a deoxyribose-phosphate aldolase polypeptide comprising an amino acid sequence that is at least about 80%, 85%, 86%, 87%, 88%, 89%, 90%, 91%, 92%, 93%, 94%, 95%, 96%, 97%, 98%, 99%, or more identical to a reference sequence selected from the even-numbered sequence identifiers of SEQ ID NO: 2-478, where the polypeptide has deoxyribose-phosphate aldolase activity and one or more of the improved properties as described herein, for example the ability to convert EGA and acetaldehyde to EDR with increased activity compared to a reference sequence (e.g., the polypeptide of SEQ ID NO: 2, 6, and/or 466). In some embodiments, the reference sequence is selected from SEQ ID NO: 2, 6, and/or 466. In some embodiments, the reference sequence is SEQ ID NO: 2. In some embodiments, the reference sequence is SEQ ID NO: 6. In some embodiments, the reference sequence is SEQ ID NO: 466.

In some embodiments, the polynucleotide encodes an engineered deoxyribose-phosphate aldolase polypeptide comprising an amino acid sequence that has the percent identity described above and (a) has at least one amino acid residue differences as compared to SEQ ID NO: 2, 6, and/or 466. In some embodiments, the present invention provides an engineered polypeptide having deoxyribose-phosphate aldolase activity comprising an amino acid sequence having at least 80%, 85%, 86%, 87%, 88%, 89%, 90%, 91%, 92%, 93%, 94%, 95%, 96%, 97%, 98%, 99%, or more sequence identity to reference sequence of SEQ ID NO: 2, 6, and/or 466, and (a) at least one amino acid residue difference selected from those substitutions provided herein (See e.g., Tables 3.1, 4.1, and 6.1).

In some embodiments, the polynucleotide encoding the engineered deoxyribose-phosphate aldolase polypeptide comprises a sequence selected from the odd-numbered sequence identifiers of SEQ ID NO: 1-477. In some embodiments, the polynucleotide sequences are selected from SEQ ID NO: 1, and 5. In some embodiments, the present invention provides engineered polynucleotides encoding polypeptides having deoxyribose-phosphate aldolase activity, wherein the engineered polypeptides have at least 80%, 85%, 86%, 87%, 88%, 89%, 90%, 91%, 92%, 93%, 94%, 95%, 96%, 97%, 98%, 99%, or more sequence identity to at least one reference sequence selected from SEQ ID NO: 2, and 6.

In some embodiments, the present invention provides a polynucleotide that hybridizes under defined conditions, such as moderately stringent or highly stringent conditions, to a polynucleotide sequence (or complement thereof) encoding an engineered deoxyribose-phosphate aldolase of the present invention. In some embodiments, the polynucleotides are capable of hybridizing under highly stringent conditions to a polynucleotide selected from the sequences having the odd-numbered sequence identifiers of SEQ ID NO: 1-477, or a complement thereof, and encodes a polypeptide having deoxyribose-phosphate aldolase activity with one or more of the improved properties described herein.

In some embodiments, the polynucleotide capable of hybridizing under highly stringent conditions encodes an engineered deoxyribose-phosphate aldolase polypeptide comprising an amino acid sequence that has one or more amino acid residue differences as compared to SEQ ID NO: 2 or SEQ ID NO: 6, as provided herein.

In some embodiments, the variant deoxyribose-phosphate aldolase of the present invention further comprises additional sequences that do not alter the encoded activity of the enzyme. For example, in some embodiments, the variant deoxyribose-phosphate aldolase is linked to an epitope tag or to another sequence useful in purification.

In some embodiments, the variant deoxyribose-phosphate aldolase polypeptides of the present invention are secreted from the host cell in which they are expressed (e.g., a yeast or filamentous fungal host cell) and are expressed as a pre-protein including a signal peptide (i.e., an amino acid sequence linked to the amino terminus of a polypeptide and which directs the encoded polypeptide into the cell secretory pathway).

When the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides of the invention can be prepared by chemical synthesis (e.g., using the classical phosphoramidite method described by Beaucage et al., Tet. Lett., 22:1859-69 [1981], or the method described by Matthes et al., EMBO J., 3:801-05 [1984], as it is typically practiced in automated synthetic methods). According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources (e.g., The Midland Certified Reagent Company, Midland, Tex., The Great American Gene Company, Ramona, Calif., ExpressGen Inc. Chicago, Ill., Operon Technologies Inc., Alameda, Calif., and many others).

The present invention also provides recombinant constructs comprising a sequence encoding at least one variant deoxyribose-phosphate aldolase, as provided herein. In some embodiments, the present invention provides an expression vector comprising a variant deoxyribose-phosphate aldolase polynucleotide operably linked to a heterologous promoter. In some embodiments, expression vectors of the present invention are used to transform appropriate host cells to permit the host cells to express the variant deoxyribose-phosphate aldolase protein. Methods for recombinant expression of proteins in fungi and other organisms are well known in the art, and a number of expression vectors are available or can be constructed using routine methods. In some embodiments, nucleic acid constructs of the present invention comprise a vector, such as, a plasmid, a cosmid, a phage, a virus, a bacterial artificial chromosome (BAC), a yeast artificial chromosome (YAC), and the like, into which a nucleic acid sequence of the invention has been inserted. In some embodiments, polynucleotides of the present invention are incorporated into any one of a variety of expression vectors suitable for expressing variant deoxyribose-phosphate aldolase polypeptide(s). Suitable vectors include, but are not limited to chromosomal, nonchromosomal and synthetic DNA sequences (e.g., derivatives of SV40), as well as bacterial plasmids, phage DNA, baculovirus, yeast plasmids, vectors derived from combinations of plasmids and phage DNA, viral DNA such as vaccinia, adenovirus, fowl pox virus, pseudorabies, adenovirus, adeno-associated virus, retroviruses, and many others. Any suitable vector that transduces genetic material into a cell, and, if replication is desired, which is replicable and viable in the relevant host finds use in the present invention.

In some embodiments, the construct further comprises regulatory sequences, including but not limited to a promoter, operably linked to the protein encoding sequence. Large numbers of suitable vectors and promoters are known to those of skill in the art. Indeed, in some embodiments, in order to obtain high levels of expression in a particular host it is often useful to express the variant deoxyribose-phosphate aldolases of the present invention under the control of a heterologous promoter. In some embodiments, a promoter sequence is operably linked to the 5' region of the variant deoxyribose-phosphate aldolase coding sequence using any suitable method known in the art. Examples of useful promoters for expression of variant deoxyribose-phosphate aldolases include, but are not limited to promoters from fungi. In some embodiments, a promoter sequence that drives expression of a gene other than a deoxyribose-phosphate aldolase gene in a fungal strain finds use. As a non-limiting example, a fungal promoter from a gene encoding an endoglucanase may be used. In some embodiments, a promoter sequence that drives the expression of a deoxyribose-phosphate aldolase gene in a fungal strain other than the fungal strain from which the deoxyribose-phosphate aldolases were derived finds use. Examples of other suitable promoters useful for directing the transcription of the nucleotide constructs of the present invention in a filamentous fungal host cell include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787, incorporated herein by reference), as well as the NA2-tpi promoter (a hybrid of the promoters from the genes for *Aspergillus niger* neutral alpha-amylase and *Aspergillus oryzae* triose phosphate isomerase), promoters such as cbh1, cbh2, egl1, egl2, pepA, hfb1, hfb2, xyn1, amy, and glaA (See e.g., Nunberg et al., Mol. Cell Biol., 4:2306-2315 [1984]; Boel et al., EMBO J., 3:1581-85 [1984]; and European Patent Appln. 137280, all of which are incorporated herein by reference), and mutant, truncated, and hybrid promoters thereof.

In yeast host cells, useful promoters include, but are not limited to those from the genes for *Saccharomyces cerevisiae* enolase (eno-1), *Saccharomyces cerevisiae* galactokinase (gal1), *Saccharomyces cerevisiae* alcohol dehydrogenase/glyceraldehyde-3-phosphate dehydrogenase (ADH2/GAP), and *S. cerevisiae* 3-phosphoglycerate kinase. Additional useful promoters useful for yeast host cells are known in the art (See e.g., Romanos et al., Yeast 8:423-488 [1992], incorporated herein by reference). In addition, promoters associated with chitinase production in fungi find use in the present invention (See e.g., Blaiseau and Lafay, Gene 120243-248 [1992]; and Limon et al., Curr. Genet., 28:478-83 [1995], both of which are incorporated herein by reference).

For bacterial host cells, suitable promoters for directing transcription of the nucleic acid constructs of the present disclosure, include but are not limited to the promoters obtained from the *E. coli* lac operon, *E. coli* trp operon, bacteriophage lambda, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl. Acad. Sci. USA 75: 3727-3731 [1978]), as well as the tac promoter (See e.g., DeBoer et al., Proc. Natl. Acad. Sci. USA 80: 21-25 [1983]).

In some embodiments, cloned variant deoxyribose-phosphate aldolases of the present invention also have a suitable transcription terminator sequence, a sequence recognized by a host cell to terminate transcription. The terminator sequence is operably linked to the 3' terminus of the nucleic acid sequence encoding the polypeptide. Any terminator that is functional in the host cell of choice finds use in the present invention. Exemplary transcription terminators for filamentous fungal host cells include, but are not limited to those obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease (See e.g., U.S. Pat. No. 7,399,627, incorporated herein by reference). In some embodiments, exemplary terminators for yeast host cells include those obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are well-known to those skilled in the art (See e.g., Romanos et al., Yeast 8:423-88 [1992]).

In some embodiments, a suitable leader sequence is part of a cloned variant deoxyribose-phosphate aldolase sequence, which is a nontranslated region of an mRNA that is important for translation by the host cell. The leader sequence is operably linked to the 5' terminus of the nucleic acid sequence encoding the polypeptide. Any leader sequence that is functional in the host cell of choice finds use in the present invention. Exemplary leaders for filamentous fungal host cells include, but are not limited to those obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the sequences of the present invention also comprise a polyadenylation sequence, which is a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice finds use in the present invention. Exemplary polyadenylation sequences for filamentous fungal host cells include, but are not limited to those obtained from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known in the art (See e.g., Guo and Sherman, Mol. Cell. Biol., 15:5983-5990 [1995]).

In some embodiments, the control sequence comprises a signal peptide coding region encoding an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

In some embodiments, the signal peptide is an endogenous *V. fluvialis* deoxyribose-phosphate aldolase signal peptide. In some additional embodiments, signal peptides from other *V. fluvialis* secreted proteins are used. In some embodiments, other signal peptides find use, depending on the host cell and other factors.

Effective signal peptide coding regions for bacterial host cells include, but are not limited to the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57: 109-137 [1993]).

Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells include, but are not limited to genes for *Saccharomyces cerevisiae* alpha-factor and *Saccharomyces cerevisiae* invertase. Other useful signal peptide coding regions are known in the art (See e.g., Romanos et al., [1992], supra).

In some embodiments, the control sequence comprises a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active deoxyribose-phosphate aldolase polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also used to allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the deoxyribose-phosphate aldolase polypeptide of the present invention would be operably linked with the regulatory sequence.

Thus, in some additional embodiments, the present invention provides recombinant expression vectors comprising a polynucleotide encoding an engineered deoxyribose-phosphate aldolase polypeptide or a variant thereof, and one or more expression regulating regions such as a promoter and a terminator, a replication origin, etc., depending on the type of hosts into which they are to be introduced. In some embodiments, the various nucleic acid and control sequences described above are joined together to produce a recombinant expression vector that may include one or more convenient restriction sites to allow for insertion or substitution of the nucleic acid sequence encoding the polypeptide at such sites. Alternatively, in some embodiments, the nucleic acid sequences are expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector comprises any suitable vector (e.g., a plasmid or virus), that can be conveniently subjected to recombinant DNA procedures and can bring about the expression of the polynucleotide sequence. The choice of the vector typically depends on the compatibility of the vector with the host cell into which the vector is to be introduced. In some embodiments, the vectors are linear or closed circular plasmids.

In some embodiments, the expression vector is an autonomously replicating vector (i.e., a vector that exists as an extrachromosomal entity, the replication of which is independent of chromosomal replication, such as a plasmid, an extrachromosomal element, a minichromosome, or an artificial chromosome). In some embodiments, the vector contains any means for assuring self-replication. Alternatively, in some other embodiments, upon being introduced into the host cell, the vector is integrated into the genome and replicated together with the chromosome(s) into which it has been integrated. Furthermore, in additional embodiments, a single vector or plasmid or two or more vectors or plasmids which together contain the total DNA to be introduced into the genome of the host cell, or a transposon find use.

In some embodiments, the expression vector of the present invention contains one or more selectable markers, which permit easy selection of transformed cells. A "selectable marker" is a gene, the product of which provides for biocide or viral resistance, resistance to antimicrobials or heavy metals, prototrophy to auxotrophs, and the like. Any suitable selectable markers for use in a filamentous fungal host cell find use in the present invention, including, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Additional markers useful in host cells such as *Aspergillus*, include but are not limited to the amdS and pyrG genes of *Aspergillus nidulans* or *Aspergillus oryzae*, and the bar gene of *Streptomyces hygroscopicus*. Suitable markers for yeast host cells include, but are not limited to ADE2, HIS3, LEU2, LYS2, MET3, TRP1, and URA3. Examples of bacterial selectable markers include, but are not limited to the dal genes from *Bacillus subtilis* or *Bacillus licheniformis*, or markers, which confer antibiotic resistance such as ampicillin, kanamycin, chloramphenicol, and or tetracycline resistance.

In some embodiments, the expression vectors of the present invention contain an element(s) that permits integration of the vector into the host cell's genome or autonomous replication of the vector in the cell independent of the genome. In some embodiments involving integration into the host cell genome, the vectors rely on the nucleic acid sequence encoding the polypeptide or any other element of the vector for integration of the vector into the genome by homologous or non-homologous recombination.

In some alternative embodiments, the expression vectors contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements preferably contain a sufficient number of nucleotides, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A on or the origins of replication of plasmids pBR322, pUC19, pACYC177 (which plasmid has the P15A ori), or pACYC184 permitting replication in *E. coli*, and pUB110, pE194, pTA1060, or pAMβ1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (See e.g., Ehrlich, Proc. Natl. Acad. Sci. USA 75:1433 [1978]).

In some embodiments, more than one copy of a nucleic acid sequence of the present invention is inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include, but are not limited to the p3xFLAG™™ expression vectors (Sigma-Aldrich Chemicals), which include a CMV promoter and hGH polyadenylation site for expression in mammalian host cells and a pBR322 origin of replication and ampicillin resistance markers for amplification in *E. coli*. Other suitable expression vectors include, but are not limited to pBluescriptII SK(-) and pBK-CMV (Stratagene), and plasmids derived from pBR322 (Gibco BRL), pUC (Gibco BRL), pREP4, pCEP4 (Invitrogen) or pPoly (See e.g., Lathe et al., Gene 57:193-201 [1987]).

Thus, in some embodiments, a vector comprising a sequence encoding at least one variant deoxyribose-phosphate aldolase is transformed into a host cell in order to allow propagation of the vector and expression of the variant deoxyribose-phosphate aldolase (s). In some embodiments, the variant deoxyribose-phosphate aldolases are post-translationally modified to remove the signal peptide and in some cases may be cleaved after secretion. In some embodiments, the transformed host cell described above is cultured in a suitable nutrient medium under conditions permitting the expression of the variant deoxyribose-phosphate aldolase(s). Any suitable medium useful for culturing the host cells finds use in the present invention, including, but not limited to minimal or complex media containing appropriate supplements. In some embodiments, host cells are grown in HTP media. Suitable media are available from various commercial suppliers or may be prepared according to published recipes (e.g., in catalogues of the American Type Culture Collection).

In another aspect, the present invention provides host cells comprising a polynucleotide encoding an improved deoxyribose-phosphate aldolase polypeptide provided herein, the polynucleotide being operatively linked to one or more control sequences for expression of the deoxyribose-phosphate aldolase enzyme in the host cell. Host cells for use in expressing the deoxyribose-phosphate aldolase polypeptides encoded by the expression vectors of the present invention are well known in the art and include but are not limited to, bacterial cells, such as *E. coli, Bacillus megaterium, Lactobacillus kefir, Streptomyces* and *Salmonella typhimurium* cells; fungal cells, such as yeast cells (e.g., *Saccharomyces cerevisiae* or *Pichia pastoris* (ATCC Accession No. 201178)); insect cells such as Drosophila S2 and Spodoptera Sf9 cells; animal cells such as CHO, COS, BHK, 293, and Bowes melanoma cells; and plant cells. Appropriate culture media and growth conditions for the above-described host cells are well known in the art.

Polynucleotides for expression of the deoxyribose-phosphate aldolase may be introduced into cells by various methods known in the art. Techniques include among others, electroporation, biolistic particle bombardment, liposome mediated transfection, calcium chloride transfection, and protoplast fusion. Various methods for introducing polynucleotides into cells are known to those skilled in the art.

In some embodiments, the host cell is a eukaryotic cell. Suitable eukaryotic host cells include, but are not limited to, fungal cells, algal cells, insect cells, and plant cells. Suitable fungal host cells include, but are not limited to, Ascomycota, Basidiomycota, Deuteromycota, Zygomycota, Fungi imperfecti. In some embodiments, the fungal host cells are yeast cells and filamentous fungal cells. The filamentous fungal host cells of the present invention include all filamentous forms of the subdivision Eumycotina and Oomycota. Filamentous fungi are characterized by a vegetative mycelium with a cell wall composed of chitin, cellulose and other complex polysaccharides. The filamentous fungal host cells of the present invention are morphologically distinct from yeast.

In some embodiments of the present invention, the filamentous fungal host cells are of any suitable genus and species, including, but not limited to *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Themioascus, Thielavia, Trametes, Tolypocladium, Trichoderma, Verticillium*, and/or *Volvariella*, and/or teleomorphs, or anamorphs, and synonyms, basionyms, or taxonomic equivalents thereof.

In some embodiments of the present invention, the host cell is a yeast cell, including but not limited to cells of *Candida, Hansenula, Saccharomyces, Schizosaccharomyces, Pichia, Kluyveromyces*, or *Yarrowia* species. In some embodiments of the present invention, the yeast cell is *Hansenula polymorpha, Saccharomyces cerevisiae, Saccharomyces carlsbergensis, Saccharomyces diastaticus, Saccharomyces norbensis, Saccharomyces kluyveri, Schizosaccharomyces pombe, Pichia pastoris, Pichia finlandica, Pichia trehalophila, Pichia kodamae, Pichia membranaefaciens, Pichia opuntiae, Pichia thermotolerans, Pichia salictaria, Pichia quercuum, Pichia pijperi, Pichia stipitis, Pichia methanolica, Pichia angusta, Kluyveromyces lactis, Candida albicans*, or *Yarrowia lipolytica*.

In some embodiments of the invention, the host cell is an algal cell such as *Chlamydomonas* (e.g., *C. reinhardtii*) and *Phormidium* (e.g., *Phormidium* sp. ATCC29409).

In some other embodiments, the host cell is a prokaryotic cell. Suitable prokaryotic cells include, but are not limited to Gram-positive, Gram-negative and Gram-variable bacterial cells. Any suitable bacterial organism finds use in the present invention, including but not limited to *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia* and *Zymomonas*. In some embodiments, the host cell is a species of *Agrobacterium, Acinetobacter, Azobacter, Bacillus, Bifidobacterium, Buchnera, Geobacillus, Campylobacter, Clostridium, Corynebacterium, Escherichia, Enterococcus, Erwinia, Flavobacterium, Lactobacillus, Lactococcus, Pantoea, Pseudomonas, Staphylococcus, Salmonella, Streptococcus, Streptomyces*, or *Zymomonas*. In some embodiments, the bacterial host strain is non-pathogenic to humans. In some embodiments the bacterial host strain is an industrial strain. Numerous bacterial industrial strains are known and suitable in the present invention. In some embodiments of the present invention, the bacterial host cell is an *Agrobacterium* species (e.g., *A. radiobacter, A. rhizogenes*, and *A. rubi*). In some embodiments of the present invention, the bacterial host cell is an *Arthrobacter* species (e.g., *A. aurescens, A. citreus, A. globiformis, A. hydrocarboglutamicus, A. mysorens, A. nicotianae, A. paraffineus, A. protophonniae, A. roseoparqffinus, A. sulfureus*, and *A. ureafaciens*). In some embodiments of the present invention, the bacterial host cell is a *Bacillus* species (e.g., *B. thuringensis, B. anthracis, B. megaterium, B. subtilis, B. lentus, B. circulans, B. pumilus, B. lautus, B. coagulans, B. brevis, B. firmus, B. alkaophius, B. licheniformis, B. clausii, B. stearothermophilus, B. halodurans*, and *B. amyloliquefaciens*). In some embodiments, the host cell is an industrial *Bacillus* strain including but not limited to *B. subtilis, B. pumilus, B. licheniformis, B. megaterium, B. clausii, B. stearothermophilus*, or *B. amyloliquefaciens*. In some embodiments, the *Bacillus* host cells are *B. subtilis, B. licheniformis, B. megaterium, B. stearothermophilus*, and/or *B. amyloliquefaciens*. In some embodiments, the bacterial host cell is a *Clostridium* species (e.g., *C. acetobutylicum, C. tetani* E88, *C. lituseburense, C. saccharobutylicum, C. perfringens*, and *C. beijerinckii*). In some embodiments, the bacterial host cell is a *Corynebacterium* species (e.g., *C. glutamicum* and *C. acetoacidophilum*). In some embodiments the bacterial host cell is an *Escherichia* species (e.g., *E. coli*). In some embodiments, the host cell is *Escherichia coli* W3110. In some embodiments, the bacterial host cell is an *Erwinia* species (e.g., *E. uredovora, E. carotovora, E. ananas, E. herbicola, E. punctata*, and *E. terreus*). In some embodiments, the bacterial host cell is a *Pantoea* species (e.g., *P. citrea*, and *P. agglomerans*). In some embodiments the bacterial host cell is a *Pseudomonas* species (e.g., *P. putida, P. aeruginosa, P. mevalonii*, and *P*. sp. D-01 10). In some embodiments, the bacterial host cell is a *Streptococcus* species (e.g., *S. equisimiles, S. pyogenes*, and *S. uberis*). In some embodiments, the bacterial host cell is a *Streptomyces* species (e.g., *S. ambofaciens, S. achromogenes, S. avermitilis, S. coelicolor, S. aureofaciens, S. aureus, S. fungicidicus, S. griseus*, and *S. lividans*). In some embodiments, the bacterial host cell is a *Zymomonas* species (e.g., *Z mobilis*, and *Z. lipolytica*).

Many prokaryotic and eukaryotic strains that find use in the present invention are readily available to the public from a number of culture collections such as American Type Culture Collection (ATCC), Deutsche Sammlung von Mikroorganismen und Zellkulturen GmbH (DSM), Centraalbureau Voor Schimmelcultures (CBS), and Agricultural Research Service Patent Culture Collection, Northern Regional Research Center (NRRL).

In some embodiments, host cells are genetically modified to have characteristics that improve protein secretion, protein stability and/or other properties desirable for expression and/or secretion of a protein. Genetic modification can be achieved by genetic engineering techniques and/or classical microbiological techniques (e.g., chemical or UV mutagenesis and subsequent selection). Indeed, in some embodiments, combinations of recombinant modification and classical selection techniques are used to produce the host cells. Using recombinant technology, nucleic acid molecules can be introduced, deleted, inhibited or modified, in a manner that results in increased yields of deoxyribose-phosphate aldolase variant(s) within the host cell and/or in the culture medium. For example, knockout of Alp1 function results in a cell that is protease deficient, and knockout of pyr5 function results in a cell with a pyrimidine deficient phenotype. In one genetic engineering approach, homologous recombination is used to induce targeted gene modifications by specifically targeting a gene in vivo to suppress expression of the encoded protein. In alternative approaches, siRNA, antisense and/or ribozyme technology find use in inhibiting gene expression. A variety of methods are known in the art for reducing expression of protein in cells, including, but not limited to deletion of all or part of the gene encoding the protein and site-specific mutagenesis to disrupt expression or activity of the gene product. (See e.g., Chaveroche et al., Nucl. Acids Res., 28:22 e97 [2000]; Cho et al., Mol. Plant Mic. Interact., 19:7-15 [2006]; Maruyama and Kitamoto, Biotechnol Lett., 30:1811-1817 [2008]; Takahashi et al., Mol. Gen. Genom., 272: 344-352 [2004]; and You et al., Arch. Microbiol., 191:615-622 [2009], all of which are incorporated by reference herein). Random mutagenesis, followed by screening for desired mutations also finds use (See e.g., Combier et al., FEMS Microbiol. Lett., 220:141-8 [2003]; and Firon et al., Eukary. Cell 2:247-55 [2003], both of which are incorporated by reference).

Introduction of a vector or DNA construct into a host cell can be accomplished using any suitable method known in the art, including but not limited to calcium phosphate transfection, DEAE-dextran mediated transfection, PEG-mediated transformation, electroporation, or other common techniques known in the art. In some embodiments, the *Escherichia coli* expression vector pCK100900i (See U.S. Pat. No. 7,629,157, which is hereby incorporated by reference) find use.

In some embodiments, the engineered host cells (i.e., "recombinant host cells") of the present invention are cultured in conventional nutrient media modified as appropriate for activating promoters, selecting transformants, or amplifying the deoxyribose-phosphate aldolase polynucleotide. Culture conditions, such as temperature, pH and the like, are those previously used with the host cell selected for expression, and are well-known to those skilled in the art. As noted, many standard references and texts are available for the culture and production of many cells, including cells of bacterial, plant, animal (especially mammalian) and archebacterial origin.

In some embodiments, cells expressing the variant deoxyribose-phosphate aldolase polypeptides of the invention are grown under batch or continuous fermentations conditions. Classical "batch fermentation" is a closed system, wherein the compositions of the medium is set at the beginning of the fermentation and is not subject to artificial alternations during the fermentation. A variation of the batch system is a "fed-batch fermentation" which also finds use in the present invention. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. "Continuous fermentation" is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady state growth conditions. Methods for modulating nutrients and growth factors for continuous fermentation processes as well as techniques for maximizing the rate of product formation are well known in the art of industrial microbiology.

In some embodiments of the present invention, cell-free transcription/translation systems find use in producing variant deoxyribose-phosphate aldolase(s). Several systems are commercially available and the methods are well-known to those skilled in the art.

The present invention provides methods of making variant deoxyribose-phosphate aldolase polypeptides or biologically active fragments thereof. In some embodiments, the method comprises: providing a host cell transformed with a polynucleotide encoding an amino acid sequence that comprises at least about 70% (or at least about 75%, at least about 80%, at least about 85%, at least about 90%, at least about 95%, at least about 96%, at least about 97%, at least about 98%, or at least about 99%) sequence identity to SEQ ID NO: 2, 6, and/or 466, and comprising at least one mutation as provided herein; culturing the transformed host cell in a culture medium under conditions in which the host cell expresses the encoded variant deoxyribose-phosphate aldolase polypeptide; and optionally recovering or isolating the expressed variant deoxyribose-phosphate aldolase polypeptide, and/or recovering or isolating the culture medium containing the expressed variant deoxyribose-phosphate aldolase polypeptide. In some embodiments, the methods further provide optionally lysing the transformed host cells after expressing the encoded deoxyribose-phosphate aldolase polypeptide and optionally recovering and/or isolating the expressed variant deoxyribose-phosphate aldolase polypeptide from the cell lysate. The present invention further provides methods of making a variant deoxyribose-phosphate aldolase polypeptide comprising cultivating a host cell transformed with a variant deoxyribose-phosphate aldolase polypeptide under conditions suitable for the production of the variant deoxyribose-phosphate aldolase polypeptide and recovering the variant deoxyribose-phosphate aldolase polypeptide. Typically, recovery or isolation of the deoxyribose-phosphate aldolase polypeptide is from the host cell culture medium, the host cell or both, using protein recovery techniques that are well known in the art, including those described herein. In some embodiments, host cells are harvested by centrifugation, disrupted by physical or chemical means, and the resulting crude extract retained for further purification. Microbial cells employed in expression of proteins can be disrupted by any convenient method, including, but not limited to freeze-thaw cycling, sonication, mechanical disruption, and/or use of cell lysing agents, as well as many other suitable methods well known to those skilled in the art.

Engineered deoxyribose-phosphate aldolase enzymes produced by a host cell can be recovered from the cells and/or the culture medium using any one or more of the techniques known in the art for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available under the trade name CelLytic B™ (Sigma-Aldrich). Thus, in some embodiments, the resulting polypeptide is recovered/isolated and optionally purified by any of a number of methods known in the art. For example, in some embodiments, the polypeptide is isolated from the nutrient medium by conventional procedures including, but not limited to, centrifugation, filtration, extraction, spray-drying, evaporation, chromatography (e.g., ion exchange, affinity, hydrophobic interaction, chromatofocusing, and size exclusion), or precipitation. In some embodiments, protein refolding steps are used, as desired, in completing the configuration of the mature protein. In addition, in some embodiments, high performance liquid chromatography (HPLC) is employed in the final purification steps. For example, in some embodiments, methods known in the art, find use in the present invention (See e.g., Parry et al., Biochem. J., 353:117 [2001]; and Hong et al., Appl. Microbiol. Biotechnol., 73:1331 [2007], both of which are incorporated herein by reference). Indeed, any suitable purification methods known in the art find use in the present invention.

Chromatographic techniques for isolation of the deoxyribose-phosphate aldolase polypeptide include, but are not limited to reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., are known to those skilled in the art.

In some embodiments, affinity techniques find use in isolating the improved deoxyribose-phosphate aldolase enzymes. For affinity chromatography purification, any antibody which specifically binds the deoxyribose-phosphate aldolase polypeptide may be used. For the production of antibodies, various host animals, including but not limited to rabbits, mice, rats, etc., may be immunized by injection with the deoxyribose-phosphate aldolase. The deoxyribose-phosphate aldolase polypeptide may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (Bacillus Calmette Guerin) and *Corynebacterium parvum*.

In some embodiments, the deoxyribose-phosphate aldolase variants are prepared and used in the form of cells expressing the enzymes, as crude extracts, or as isolated or purified preparations. In some embodiments, the deoxyribose-phosphate aldolase variants are prepared as lyophilisates, in powder form (e.g., acetone powders), or prepared as enzyme solutions. In some embodiments, the deoxyribose-phosphate aldolase variants are in the form of substantially pure preparations.

In some embodiments, the deoxyribose-phosphate aldolase polypeptides are attached to any suitable solid substrate. Solid substrates include but are not limited to a solid phase, surface, and/or membrane. Solid supports include, but are not limited to organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of the substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments.

In some embodiments, immunological methods are used to purify deoxyribose-phosphate aldolase variants. In one approach, antibody raised against a variant deoxyribose-phosphate aldolase polypeptide (e.g., against a polypeptide comprising an engineered deoxyribose-phosphate aldolase variant provided herein, including, but not limited to SEQ ID NO: 2, 6, and/or 466, and variants thereof, and/or an immunogenic fragment thereof) using conventional methods is immobilized on beads, mixed with cell culture media under conditions in which the variant deoxyribose-phosphate aldolase is bound, and precipitated. In a related approach, immunochromatography finds use.

In some embodiments, the variant deoxyribose-phosphate aldolases are expressed as a fusion protein including a non-enzyme portion. In some embodiments, the variant deoxyribose-phosphate aldolase sequence is fused to a purification facilitating domain. As used herein, the term "purification facilitating domain" refers to a domain that mediates purification of the polypeptide to which it is fused. Suitable purification domains include, but are not limited to metal chelating peptides, histidine-tryptophan modules that allow purification on immobilized metals, a sequence which binds glutathione (e.g., GST), a hemagglutinin (HA) tag (corresponding to an epitope derived from the influenza hemagglutinin protein; See e.g., Wilson et al., Cell 37:767 [1984]), maltose binding protein sequences, the FLAG epitope utilized in the FLAGS extension/affinity purification system (e.g., the system available from Immunex Corp), and the like. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography; See e.g., Porath et al., Prot. Exp. Purif., 3:263-281 [1992]) while the enterokinase cleavage site provides a means for separating the variant deoxyribose-phosphate aldolase polypeptide from the fusion protein. pGEX vectors (Promega) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

Methods of Using the Engineered Deoxyribose-Phosphate Aldolase Enzymes

In another aspect, the engineered deoxyribose-phosphate aldolase polypeptides disclosed herein can be used in a process for the conversion of EGA and acetaldehyde to EDR.

As described herein, and illustrated in the Examples, the present invention contemplates ranges of suitable reaction conditions that can be used in the processes herein, including but not limited to ranges of pH, temperature, buffer, solvent system, substrate loading, mixture of substrate compound stereoisomers, polypeptide loading, pressure, and reaction time. Further suitable reaction conditions for carrying out the process for biocatalytic conversion of substrate compounds to product compounds using an engineered deoxyribose-phosphate aldolase polypeptide described herein can be readily optimized by routine experimentation that includes, but is not limited to, contacting the engineered deoxyribose-phosphate aldolase polypeptide and substrate compound under experimental reaction conditions of concentration, pH, temperature, solvent conditions, and detecting the product compound, for example, using the methods described in the Examples provided herein.

As described above, the engineered polypeptides having deoxyribose-phosphate aldolase activity for use in the processes of the present invention generally comprise an amino acid sequence having at least 80%, 85%, 86%, 87%, 88%, 89%, 90%, 91%, 92%, 93%, 94%, 95%, 96%, 97%, 98%, 99%, or more identity to a reference amino acid sequence selected from any one of the even-numbered sequences of SEQ ID NO: 2 to 478, and an engineered deoxyribose-phosphate aldolase polypeptide comprising an amino acid sequence that has (a) has one or more amino acid residue differences as compared to a reference sequence (e.g., SEQ ID NO: 2, 6, and/or 466). In some embodiments, the polynucleotide capable of hybridizing under highly stringent conditions encodes a deoxyribose-phosphate aldolase polypeptide that has the percent identity described above and one or more residue differences as compared to a reference sequence (e.g., SEQ ID NO: 2, 6, and/or 466).

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments of the method, the suitable reaction conditions comprise a substrate compound loading of at least about 0.5 to about 200 g/L, 1 to about 200 g/L, 5 to about 150 g/L, about 10 to about 100 g/L, or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of compound (Y), however it also contemplated that the equivalent molar amounts of various hydrates and salts of EDR also can be used in the process.

During the course of the reactions, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, carbonate, phosphate, triethanolamine (TEA) buffer, and the like. In some embodiments, the buffer is TEA. In some embodiments of the process, the suitable reaction conditions comprise a MOPS (−3-(N-morpholino) propanesulfonic acid, pH 7), buffer at a concentration of about 0.01 M to 0.5 M. In some embodiments, the reaction conditions comprise water as a suitable solvent with no buffer present.

In some embodiments of the process, the reaction conditions can comprise a suitable pH. As noted above, the desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH of about 5 to 10, about 6 to 9, about 7 to 11, about 8 to about 12.5, a pH of about 8 to about 12, a pH of about 9.0 to about 11.5, or a pH of about 9.5 to about 11.0. In some embodiments, the reaction conditions comprise a solution pH of about 8, 8.5, 9, 9.5, 10, 10.5, 11, 11.5, 12 or 12.5. In some alternative embodiments, the reaction conditions comprise a solution pH of about 6.5 to about 7.5. In some embodiments, the pH is about 5, 5.5, 6.5, 6.6, 6.7, 6.8, 6.9, 7.0, 7.1, 7.2, 7.3, 7.4, 7.5, 8, 8.5, 9, 9.5, 10, 10.5, 11, 11.5, 12, or 12.5. In yet some additional embodiments, the reaction conditions comprise a solution pH of about 5 to about 10. In some embodiment the pH is about 5, 5.5, 6, 6.5, 7, 7.5, 8, 8.5, 9, 9.5, or 10.

In some embodiments of the processes herein, a suitable temperature can be used for the reaction conditions, for example, taking into consideration the increase in reaction rate at higher temperatures, the activity of the enzyme for sufficient duration of the reaction, and as further described below. For example, the engineered polypeptides of the present invention have increased stability relative to naturally occurring deoxyribose-phosphate aldolase polypeptide, which allows the engineered polypeptides of the present invention to be used at higher temperatures for increased conversion rates and improved substrate solubility characteristics for the reaction. Accordingly, in some embodiments, the suitable reaction conditions comprise a temperature of about 10° C. to about 70° C., about 10° C. to about 65° C., about 15° C. to about 60° C., about 20° C. to about 60° C., about 20° C. to about 55° C., about 30° C. to about 55° C., or about 40° C. to about 50° C. In some embodiments, the suitable reaction conditions comprise a temperature of about 10° C., 15° C., 20° C., 25° C., 30° C., 35° C., 40° C., 45° C., 50° C., 55° C., 60° C., 65° C., or 70° C. In some embodiments, the temperature during the enzymatic reaction can be maintained at a temperature throughout the course of the reaction. In some embodiments, the temperature during the enzymatic reaction can be adjusted over a temperature profile during the course of the reaction.

The processes using the engineered deoxyribose-phosphate aldolases are generally carried out in a solvent. Suitable solvents include water, aqueous buffer solutions, organic solvents, and/or co-solvent systems, which generally comprise aqueous solvents and organic solvents. The aqueous solvent (water or aqueous co-solvent system) may be pH-buffered or unbuffered.

The suitable reaction conditions can comprise a combination of reaction parameters that provide for the biocatalytic conversion of the substrate compounds to its corresponding product compounds. Accordingly, in some embodiments of the process, the combination of reaction parameters comprises: (a) substrate loading of about 0.01 to 50 g/L of substrate compound; (b) engineered polypeptide concentration of about 1 g/L to 10 g/L; (c) pH of about 7; and (e) temperature of about 22-5530.

In some embodiments, the combination of reaction parameters comprises: (a) about 2.5 g/L of substrate compound (e.g., 50 g/L EGA and 3 molar equivalents of acetaldehyde); (b) about 2.5 g/L engineered polypeptide; (c) about pH 7; and (d) about 30° C.

Further exemplary reaction conditions include the assay conditions provided in the Examples. In carrying out the reactions described herein, the engineered deoxyribose-phosphate aldolase polypeptide may be added to the reaction mixture in the partially purified or purified enzyme, whole cells transformed with gene(s) encoding the enzyme, and/or as cell extracts and/or lysates of such cells. Whole cells transformed with gene(s) encoding the engineered deoxyribose-phosphate aldolase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (e.g., ammonium sulfate, polyethyleneimine, heat treatment or the like), followed by a desalting procedure (e.g., ultrafiltration, dialysis, and the like) prior to lyophilization. Any of the enzyme preparations may be stabilized by crosslinking using known crosslinking agents, such as, for example, glutaraldehyde, or immobilized to a solid phase material (e.g., resins, beads such as chitosan, Eupergit C, SEPABEADs, and the like).

In some embodiments of the reactions described herein, the reaction is carried out under the suitable reaction conditions described herein, wherein the engineered deoxyribose-phosphate aldolase polypeptide is immobilized to a solid support. Solid supports useful for immobilizing the engineered deoxyribose-phosphate aldolases for carrying out the reactions include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments where the engineered polypeptide can be expressed in the form of a secreted polypeptide, the culture medium containing the secreted polypeptides can be used in the process herein.

In some embodiments, solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the deoxyribose-phosphate aldolase, and deoxyribose-phosphate aldolase substrate may be added first to the solvent. For improved mixing efficiency when an aqueous co-solvent system is used, the deoxyribose-phosphate aldolase may be added and mixed into the aqueous phase first. The organic phase may then be added and mixed in, followed by addition of the deoxyribose-phosphate aldolase substrate. Alternatively, the deoxyribose-phosphate aldolase substrate may be premixed in the organic phase, prior to addition to the aqueous phase.

Methods, techniques, and protocols for extracting, isolating, forming a salt of, purifying, and/or crystallizing product compounds from biocatalytic reaction mixtures produced by the above disclosed processes are known to the ordinary artisan and/or accessed through routine experimentation. Additionally, illustrative methods are provided in the Examples below.

Various features and embodiments of the invention are illustrated in the following representative examples, which are intended to be illustrative, and not limiting.

EXPERIMENTAL

Various features and embodiments of the invention are illustrated in the following representative examples, which are intended to be illustrative, and not limiting.

In the experimental invention below, the following abbreviations apply: ppm (parts per million); M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); ° C. (degrees Centigrade); RT (room temperature); CDS (coding sequence); DNA (deoxyribonucleic acid); RNA (ribonucleic acid); aa (amino acid); TB (Terrific Broth; 12 g/L bacto-tryptone, 24 g/L yeast extract, 4 mL/L glycerol, 65 mM potassium phosphate, pH 7.0, 1 mM MgSO4); LB (Luria broth); CAM (chloramphenicol); PMBS (polymyxin B sulfate); IPTG (isopropyl thiogalactoside); DERA (deoxyribose-phosphate aldolase); DNPH.HCl (2,4-dinitrophenyl-hydrazine hydrochloride); TFA (trifluoroacetic acid); TEoA (triethanolamine); borate (sodium tetraborate decahydrate); acetonitrile (MeCN); dimethylsulfoxide (DMSO); HPLC (high performance liquid chromatography); FIOP (fold improvement over positive control); HTP (high throughput); MWD (multiple wavelength detector); UV (ultraviolet); Codexis (Codexis, Inc., Redwood City, Calif.); Sigma-Aldrich (Sigma-Aldrich, St. Louis, Mo.); Millipore (Millipore, Corp., Billerica Mass.); Difco (Difco Laboratories, BD Diagnostic Systems, Detroit, Mich.); Daicel (Daicel, West Chester, Pa.); Genetix (Genetix USA, Inc., Beaverton, Oreg.); Molecular Devices (Molecular Devices, LLC, Sunnyvale, Calif.); Applied Biosystems (Applied Biosystems, part of Life Technologies, Corp., Grand Island, N.Y.), Agilent (Agilent Technologies, Inc., Santa Clara, Calif.); Thermo Scientific (part of Thermo Fisher Scientific, Waltham, Mass.); (Infors; Infors-HT, Bottmingen/Basel, Switzerland); Corning (Corning, Inc., Palo Alto, Calif.); and Bio-Rad (Bio-Rad Laboratories, Hercules, Calif.); Microfluidics (Microfluidics Corp., Newton, Mass.); and Waters (Waters Corp., Milford, Mass.).

Example 1

Preparation of HTP DERA-Containing Wet Cell Pellets

The parent gene for the DERA (SEQ ID NO: 2) enzyme used to produce the variants of the present invention were synthesized and cloned into a pCK110900 vector (See e.g., U.S. Pat. No. 7,629,157 and US Pat. Appln. Publn. 2016/0244787, both of which are hereby incorporated by reference in their entireties and for all purposes). A 6-Histidine tag was added to the N-terminus of the parent when cloned into pCK110900. W3110 *E. coli* cells were transformed with the respective plasmid containing the DERA-encoding genes and plated on Luria broth (LB) agar plates containing 1% glucose and 30 μg/ml chloramphenicol (CAM), and grown overnight at 37° C. Monoclonal colonies were picked and inoculated into 180 μl LB containing 1% glucose and 30 μg/mL chloramphenicol 96-well shallow-well microtiter plates. The plates were sealed with $O_2$-permeable seals and cultures were grown overnight at 30° C., 200 rpm and 85% humidity. Then, 10 μl of each of the cell cultures were transferred into the wells of 96 well deep-well plates containing 390 μl TB and 30 μg/mL CAM. The deep-well plates were sealed with $O_2$-permeable seals and incubated at 30° C., 250 rpm and 85% humidity until $OD_{600}$ 0.6-0.8 was reached. The cell cultures were then induced by isopropyl thioglycoside (IPTG) to a final concentration of 1 mM and incubated overnight for 18-20 hrs at 30° C., 250 rpm. The cells were then pelleted using centrifugation at 4000 rpm for 10 min. The supernatants were discarded and the pellets frozen at −80° C. prior to lysis.

Example 2

Preparation of DERA-Containing Cell Lysates

Frozen DERA-containing cell pellets prepared as described in Example 1 were lysed with 400 μl lysis buffer containing 50 mM 3-(N-morpholino)propanesulfonic acid (MOPS) buffer, pH 7.0, 1 mg/mL lysozyme and 0.5 mg/mL PMBS. The lysis mixture was shaken at room temperature for 2 hours. The plate was then centrifuged for 15 mM at 4000 rpm and 4° C. The supernatants were then used in biocatalytic reactions as clarified lysate to determine the activity levels, as described in the following Examples.

Example 3

Production of Compound Y (EDR) by Deoxyribose-Phosphate Aldolase Variants

SEQ ID NO: 2 was selected as the parent enzyme for these experiments. Libraries of engineered genes were produced using well-established techniques (e.g., saturation mutagenesis, and recombination of previously identified beneficial mutations). The polypeptides encoded by each gene were produced in HTP as described in Example 1, and the clarified lysate was generated as described in Example 2.

Each 60 μL reaction was carried out in 96-well shallow well microtiter plates with 10 μL HTP lysate, 24 g/L compound X (enantiopure (R)-2-ethynyl-glyceraldehyde), 24 g/L (3 molar equivalence) of acetaldehyde in 50 mM MOPS buffer at pH 7. The plates were heat sealed and incubated at 30° C. and agitated at 600 RPM in an Infors Thermotron® shaker for 3 hrs. For achiral conversion analysis, 10 μL of reaction mixture was transferred into 190 μL of freshly made DNPH.HCl (42.6 g/L in DMSO) in 1 mL Axygen 96-well plates, and derivatization reactions were incubated at 40° C. for 1 hr shaking at 600 rpm. Then, 10 μL of derivatized mixture was transferred into 96-well Millipore filter plates (0.45 μm pore size) pre-filled with 190 μL of MeCN/NaOH (4.7 μL NaOH per mL of MeCN), mixed and then centrifuge for achiral LC-MS analysis, as described in Example 5.

TABLE 3.1

Production of Compound Y (EDR)

| SEQ ID NO: (nt/aa) | Amino Acid Differences (Relative to SEQ ID NO: 2) | Activity (Relative to SEQ ID NO: 2)[1] |
|---|---|---|
| 61/62 | M184I | +++ |
| 83/84 | S2R | +++ |
| 115/116 | V203I | +++ |
| 51/52 | S236D | +++ |
| 7/8 | Q10R/C47M/L88A/L156I | +++ |
| 67/68 | F197M | +++ |
| 93/94 | C47V | +++ |
| 59/60 | S235T | ++ |
| 5/6 | Q10R/C47M/D66P/S141T/A145K/L156I | ++ |
| 49/50 | D102E | ++ |
| 21/22 | K6H | ++ |
| 81/82 | S2C | ++ |
| 65/66 | A71V | ++ |

TABLE 3.1-continued

Production of Compound Y (EDR)

| SEQ ID NO: (nt/aa) | Amino Acid Differences (Relative to SEQ ID NO: 2) | Activity (Relative to SEQ ID NO: 2)[1] |
|---|---|---|
| 133/134 | T133I/A173V/K204T/S235D/S236H | ++ |
| 75/76 | D66L | ++ |
| 123/124 | C47M | ++ |
| 3/4 | C47M/I134L/S141T/F212Y | ++ |
| 71/72 | E112M | ++ |
| 91/92 | I46V | ++ |
| 13/14 | D66S | ++ |
| 15/16 | M184V | ++ |
| 47/48 | T133L | ++ |
| 99/100 | V94L | ++ |
| 109/110 | F197C | ++ |
| 125/126 | S13I | + |
| 113/114 | T133M | + |
| 105/106 | E112K | + |
| 33/34 | S13R | + |
| 69/70 | A207G | + |
| 77/78 | P147A | + |
| 43/44 | A145V/A173R | + |
| 37/38 | E112L | + |
| 29/30 | T72C | + |
| 129/130 | V104T | + |
| 119/120 | T116G | + |
| 101/102 | S2W | + |
| 87/88 | S13Q | + |
| 135/136 | S235D/S236R | + |
| 45/46 | T226S | + |
| 57/58 | Q9R | + |
| 131/132 | S235D | + |
| 17/18 | K6Y | + |
| 9/10 | I134L | + |
| 73/74 | I134V | + |
| 117/118 | S13L | + |
| 11/12 | D66P/L88A/E112A/I134L/S141T/V143E/A145K/F212Y | + |
| 35/36 | K6W | + |
| 121/122 | S236C | + |
| 107/108 | S189A | + |
| 25/26 | V94K | + |
| 85/86 | D66I | + |
| 111/112 | A173P | + |
| 55/56 | V94M | + |
| 95/96 | E31L | + |
| 137/138 | K204T | + |
| 89/90 | L88T | + |
| 79/80 | P147K | + |
| 97/98 | T116P | + |
| 19/20 | D66P | + |
| 39/40 | E112H | + |
| 103/104 | A145C | + |
| 41/42 | A145R | + |
| 27/28 | L88R | + |
| 23/24 | D66T | + |
| 31/32 | A173T | + |
| 127/128 | S189R | + |
| 63/64 | P147S | + |
| 53/54 | E112R | + |

[1]Levels of increased activity were determined relative to the reference polypeptide of SEQ ID NO: 2, and are defined as follows: "+" = 1.2 to 1.5; "++" >1.5 to 2.0; and "+++" >2.0

Activity relative to SEQ ID NO: 2 was calculated as the % conversion of the product formed by the variant relative to the percent conversion of the product formed by SEQ ID NO: 2. Percent conversion was quantified by dividing the area of the product peak by the sum of the area of the substrate as determined by LC-MS analysis, as described in Example 5.

Example 4

Production of Compound Y (EDR) by Deoxyribose-Phosphate Aldolase Variants

SEQ ID NO: 6 was selected as the parent enzyme for these experiments. Libraries of engineered genes were produced using well-established techniques (e.g., saturation mutagenesis, and recombination of previously identified beneficial mutations). The polypeptides encoded by each gene were produced in HTP as described in Example 1, and the clarified lysate was generated as described in Example 2.

Each 60 μL reaction was carried out in 96-well shallow well microtiter plates with 5 μL HTP lysate, 24 g/L compound X (enantiopure (R)-2-ethynyl-glyceraldehyde), 24 g/L (3 molar equivalence) of acetaldehyde in 50 mM MOPS buffer at pH 7. The plates were heat sealed and incubated at 30° C. and agitated at 600 RPM in an Infors Thermotron® shaker for 3 hrs. For achiral conversion analysis, 10 μL of reaction mixture was transferred into 190 μL of freshly made DNPH.HCl (42.6 g/L in DMSO) in 1 mL Axygen 96-well plates, and derivatization reactions were incubated at 40° C. for 1 hr shaking at 600 rpm. Then, 10 μL of derivatized mixture was transferred into 96-well Millipore filter plates (0.45 μm pore size) pre-filled with 190 μL of MeCN/NaOH (4.7 μL NaOH per mL of MeCN), mixed and then centrifuged for achiral LC-MS analysis as described in Example 5.

TABLE 4.1

Production of Compound Y (EDR)

| SEQ ID NO: (nt/aa) | Amino Acid Differences (Relative to SEQ ID NO: 6) | Activity (Relative to SEQ ID NO: 6)[1] |
|---|---|---|
| 235/236 | P66S/T133M/M184V | +++ |
| 325/326 | T133H | +++ |
| 203/204 | S13I/I46V/P66S/T133L/I134L/M184V | +++ |
| 243/244 | S13I/I46V/P66S/M184V | +++ |
| 157/158 | S13I/I46V/E112K/I134L/M184V | +++ |
| 225/226 | E112K/T133M/I134L | +++ |
| 153/154 | P66S/V94E/E112K/M184V/K204T | +++ |
| 199/200 | S13I/P66S/E112K/T133M/I134L/M184V/K204T | +++ |
| 239/240 | S13I/P66S/T133M/I134L/M184V/K204T | +++ |
| 185/186 | S13I/V94L/M184V | +++ |
| 159/160 | P66S/V94E/E112M/T133M/M184V | +++ |
| 217/218 | S13I/I46V | +++ |

TABLE 4.1-continued

Production of Compound Y (EDR)

| SEQ ID NO: (nt/aa) | Amino Acid Differences (Relative to SEQ ID NO: 6) | Activity (Relative to SEQ ID NO: 6)[1] |
|---|---|---|
| 151/152 | P66S/E112K/I134L/F197C | +++ |
| 197/198 | S13I/I46V/P66S/V94L/M184V/K204T | +++ |
| 173/174 | I46V/P66S/T133M/F197C | +++ |
| 321/322 | P66H | +++ |
| 139/140 | P66S/V94L/E112K/T133L/M184V | +

TABLE 4.1-continued

| Production of Compound Y (EDR) | | |
|---|---|---|
| SEQ ID NO: (nt/aa) | Amino Acid Differences (Relative to SEQ ID NO: 6) | Activity (Relative to SEQ ID NO: 6)[1] |
| 255/256 | T133L | + |
| 277/278 | E112C | + |
| 301/302 | E127L | + |
| 265/266 | E120R | + |
| 297/298 | N114R | + |
| 275/276 | A84C | + |
| 253/254 | E115D | + |
| 249/250 | E115V | + |
| 327/328 | M47V; L88A; D102E; T141S; S235T; S236D | + |
| 329/330 | M47V; A71V; M184I; S235T | + |
| 331/332 | M47V; T141S; M184I | + |
| 333/334 | K6H; V203I; S235T; S236D | + |
| 335/336 | M47V; A71V; M184I | + |
| 337/338 | D102E; F197M; S235D | + |
| 339/340 | M47V; V203I; S235D | + |
| 341/342 | P66L; L88A; S235D | + |
| 345/346 | M47V; P66L; L88A; M184I; S235T | + |
| 347/348 | L88A; M184I; F197M; S235D; S236D | + |
| 349/350 | T141S; V203I; S235D; S236D | + |
| 351/352 | T141S; F197M | + |
| 353/354 | M47V; V203I; S236D | + |
| 355/356 | P66L; D102E; M184I; S235D; S236D | + |
| 357/358 | S2R; R10Q; D102E; S235T; S236D | + |
| 359/360 | R10Q; M47V; P66L; S235T; S236D | + |
| 361/362 | L88A; S236D | + |
| 365/366 | M47V; D102E; V203I; S235T; S236D | + |
| 363/364 | M47V; S235T; S236D | + |
| 343/344 | S236D | + |
| 367/368 | M47V; A71V; T141S; M184I; V203I; S235D | + |
| 369/370 | M47V; P66L; M184I; F197M; S236D | + |
| 371/372 | M47V; P66L; T141S; S235T; S236D | + |
| 373/374 | S2R; K6H; D102E; T141S; V203I; S235T | + |
| 375/376 | D102E; T141S; V203I | + |
| 377/378 | M47V; E88A; V203I; S235D; S236D | + |
| 379/380 | R10Q; M47V; P66L; M184I; F197M; S236D | + |
| 381/382 | M47V; E88A; S235T; S236D | + |
| 383/384 | M47V; A71V; M184I; S236D | + |
| 387/388 | T141S; S236D | + |
| 389/390 | M47V; P66L; M184I; F197M; V203I; S235T; S236D | + |
| 391/392 | S2R; V203I; S235T; S236D | + |
| 393/394 | E88A; M184I; V203I; S235D | + |
| 395/396 | P66L; E88A; D102E; M184I; F197M; V203I; S235T; S236D | + |
| 397/398 | S2C; M47V; A71V; T141S; F197M; S235T; S236D | + |
| 399/400 | F197M; S235D | + |
| 401/402 | L88A; D102E; T141S; M184I; S235T; S236D | + |
| 403/404 | M47V; D102E; M184I; F197M; S235T; S236D | + |
| 405/406 | S235T; S236D | ++ |
| 407/408 | D102E; M184I; S236D | ++ |
| 409/410 | P66L; L88A; F197M | ++ |
| 385/386 | L88A; M184I | ++ |
| 415/416 | M47V; V203I; S235T; S236D | ++ |
| 417/418 | S235D; S236D | ++ |
| 419/420 | S2R; K6H; R10Q; P66L; L88A; D102E; M184I; S235T; S236D | ++ |
| 413/414 | M47V; T141S; M184I; S236D | ++ |
| 421/422 | D102E; M184I; V203I; S236D | ++ |
| 423/424 | S2R; L88A; T141S; S235D; S236D | ++ |
| 425/426 | M47V; P66L; A71V; L88A; V203I; S235T; S236D | ++ |
| 411/412 | M47V; M184I; S236D | ++ |
| 427/428 | L88A; M184I; F197M; V203I; S235T; S236D | ++ |
| 429/430 | P66L; L88A; S235T; S236D | ++ |
| 431/432 | M47V; P66L; A71V; T141S; M184I | ++ |
| 435/436 | T141S; M184I; S235D | ++ |
| 437/438 | V203I; S236D | ++ |
| 441/442 | S2C; M47V; A71V; L88A; V203I; S235T; S236D | +++ |
| 443/444 | M47V; A71V; L88A; M184I; V203I; S235D | +++ |
| 445/446 | M47V; A71V; L88A; M184I; V203I; S236D | +++ |
| 447/448 | L88A; F197M; S235T; S236D | +++ |
| 433/434 | M184I; S236D | +++ |

TABLE 4.1-continued

Production of Compound Y (EDR)

| SEQ ID NO: (nt/aa) | Amino Acid Differences (Relative to SEQ ID NO: 6) | Activity (Relative to SEQ ID NO: 6)[1] |
|---|---|---|
| 439/440 | V203I; S235T; S236D | +++ |
| 449/450 | M184I; V203I | +++ |
| 451/452 | M47V; A71V; M184I; F197M; S236D | +++ |
| 453/454 | P66L; M184I | +++ |
| 455/456 | L88A; M184I; S236D | +++ |
| 457/458 | M47V; P66L; L88A; V203I; S235T; S236D | +++ |
| 459/460 | M184I; V203I; S235D | +++ |
| 461/462 | M184I; V203I; S236D | +++ |
| 463/464 | M184I; S235T; S236D | +++ |
| 465/466 | S2C; M47V; P66L; A71V; T141S; M184I; V203I; S235T; S236D | +++ |
| 467/468 | R10Q; M47V; A71V; M184I; V203I; S235T; S236D | +++ |
| 469/470 | P66L; F197M; V203I; S235D | +++ |
| 471/472 | T141S; M184I; V203I; S235T; S236D | +++ |

[1]Levels of increased activity were determined relative to the reference polypeptide of SEQ ID NO: 6, and are defined as follows: "+" = 1.2 to 2.0 ; "++" >2.0 to 2.5; and "+++" >2.5

Activity relative to SEQ ID NO: 6 was calculated as the % conversion of the product formed by the variant relative to the percent conversion of the product formed by SEQ ID NO: 6. Percent conversion was quantified by dividing the area of the product peak by the sum of the area of the substrate as determined by LC-MS analysis, as described in Example 5.

Example 5

Analytical Detection of Compound Y (EDR)

Data described in Examples 3 and 4 were collected using the analytical method in Table 5.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

TABLE 5.1

| Analytical Method | |
|---|---|
| Instrument | Waters Acquity UPLC with Sciex 3200 QTrap MS |
| Column | Acentis Express C18 2.7 μm 3 × 100 mm (Catalog number: 53814-U) |
| Mobile Phase | Isocratic 50:50 A and B where A is LC/MS grade water containing 0.05% TFA and B is LC/MS grade MeCN |
| Flow Rate | 0.50 mL/min |
| Run Time | ~2.5 min |

TABLE 5.1-continued

| Analytical Method | |
|---|---|
| Substrate and Product Elution order | DNPH-derivatized EDR: 1.0 min<br>DNPH-derivatized substrate: 1.3 min |
| Column Temperature | 45° C. |
| Injection Volume | 10 μL |
| Detection | MS detection: ESI-Positive ion mode IonSpray (IS) 5500, Curtain gas (CUR) 20, CAD gas High, Gas 1/Gas 2 (GS1/GS2) 50, Declustering potential (DP) 70, Entrance Potential (EP) 10, Collision Energy (CE) 20, Exit Potential (CXP) 3. Two transitions were monitored for 200 msec each: MRM product (1) 339 → 195.8, MRM substrate (2) 295 → 200 |

Example 6

Evolution and Screening of Engineered Polypeptides Derived from SEQ ID NO: 466 for Improved Aldolase Activity The engineered polynucleotide (SEQ ID NO: 465) encoding the polypeptide with deoxyribose-phosphate aldolase activity of SEQ ID NO: 466 was used to generate the engineered polypeptides of Table 6.1. These polypeptides displayed improved deoxyribose-phosphate aldolase activity under the desired conditions (e.g. ability to produce compound 4 as measured via the production of compound 1 in the presence of SP and engineered PPM and PNP enzymes as shown in Scheme 1) as compared to the starting polypeptide.

Scheme 1

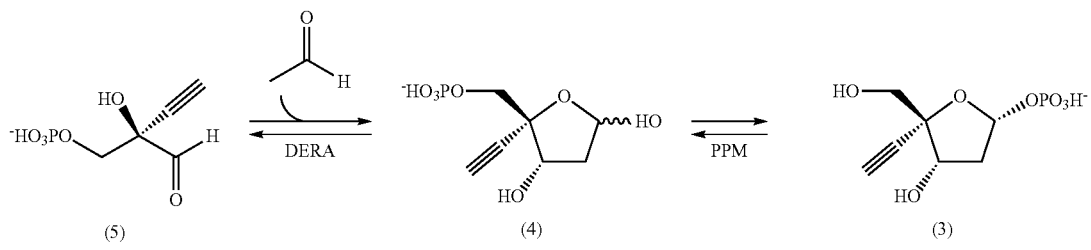

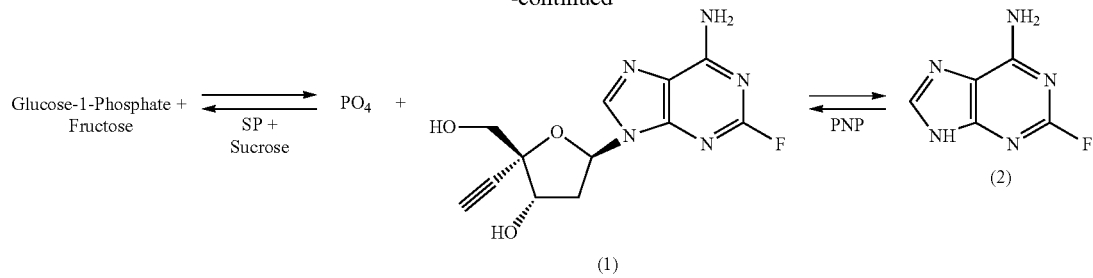

The engineered polypeptides, having the amino acid sequences of even-numbered sequence identifiers were generated from the "backbone" amino acid sequence of SEQ ID NO: 466 as described below. Directed evolution began with the polynucleotide set forth in SEQ ID NO: 465. Libraries of engineered polypeptides were generated using various well-known techniques (e.g., saturation mutagenesis, recombination of previously identified beneficial amino acid differences) and were screened using HTP assay and analysis methods that measured the polypeptides' aldolase activity. In this case, activity was measured via the production of compound 1 in the presence of sucrose phosphorylase (SP) and engineered phosphopentose mutase (PPM) and purine nucleoside phosphorylase (PNP) enzymes as shown in Scheme 1 using the analytical method in Table 6.2. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal DERA variants were prepared as described in Example 1 and were lysed with 400 μl lysis buffer containing 100 mM triethanolamine buffer, pH 7.5, 1 mg/mL lysozyme, and 0.5 mg/mL PMBS. The lysis mixture was shaken at room temperature for 2 hours. The plate was then centrifuged for 15 min at 4000 rpm and 4° C.

Shake flask powders (lyophilized lysates from shake flask cultures) were prepared as follows. Cell cultures of desired variants were plated onto LB agar plates with 1% glucose and 30 μg/ml CAM, and grown overnight at 37° C. A single colony from each culture was transferred to 6 ml of LB with 1% glucose and 30 μg/ml CAM. The cultures were grown for 18 h at 30° C., 250 rpm, and subcultured approximately 1:50 into 250 ml of TB containing 30 μg/ml CAM, to a final $OD_{600}$ of 0.05. The cultures were grown for approximately 195 minutes at 30° C., 250 rpm, to an $OD_{600}$ between 0.6-0.8 and induced with 1 mM IPTG. The cultures were then grown for 20 h at 30° C., 250 rpm. The cultures were centrifuged 4000 rpm for 10 mM. The supernatant was discarded, and the pellets were resuspended in 30 ml of 20 mM Triethanolamine, pH 7.5, and lysed using a Microfluidizer® processor system (Microfluidics) at 18,000 psi. The lysates were pelleted (10,000 rpm for 60 min), and the supernatants were frozen and lyophilized.

Reactions were performed in a tandem 4-enzyme cascade setup involving DERA/PPM/PNP/SP enzymes in a 96-well format in 2 mL deep-well plates, with 100 μL total volume. Reactions included PNP, PPM and SP as shake flask powders (30 wt % PPM SEQ ID NO: 480, 0.5 wt % PNP SEQ ID NO: 482, 4 wt % Wild type SP SEQ ID NO: 484), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 5 mM $MnCl_2$ and 50 mM TEoA, pH 7.5. The reactions were set up as follows: (i) all the reaction components, except for DERA, were pre-mixed in a single solution and 90 μL of this solution was then aliquoted into each well of the 96-well plates (ii) 10 μL of DERA lysate, pre-diluted 100 fold using 50 mM TEoA buffer, was then added into the wells to initiate the reaction. The reaction plate was heat-sealed, incubated at 35° C., with 600 rpm shaking, for 18-20 hours.

The reactions were quenched with 300 μL 1:1 mixture of 1M KOH and DMSO. The quenched reactions were shaken for 10 min on a tabletop shaker followed by centrifugation at 4000 rpm for 5 mins at 4° C. to pellet any precipitate. Ten microliters of the supernatant was then transferred into a 96-well round bottom plate prefilled with 190 μL of 25% MeCN in 0.1 M TEoA pH 7.5 buffer. The samples were injected on to Thermo U3000 UPLC system and were separated using Atlantis T3 C18, 3 μm, 2.1×100 mm column isocratically with a mobile phase containing 75:25 water: acetonitrile supplemented with 0.1% TFA as described in Example 6-2. Activity relative to SEQ ID NO: 466 was calculated as the peak area of compound 1 formed by the variant enzyme, compared to peak area of compound 1 formed by SEQ ID NO: 466 under the specified reaction conditions.

Select variants were grown in 250-mL shake flask and enzyme powders generated as described above. The activity of the enzyme powders were evaluated at 0.004-8 wt % shake flask powder, using similar assay as described above. Data shown in Table 6.1 reflects activity relative to SEQ ID NO: 466 calculated as the peak area of compound 1 formed by the variant enzymes, compared to peak area of compound 1 formed by SEQ ID NO: 466 with 0.04 wt % shake flask powder of the DERA variants.

TABLE 6.1

DERA Variant Activity Relative to SEQ ID NO: 466

| SEQ ID NO: (nt/aa) | Amino Acid Differences (Relative to SEQ ID NO: 466) | Percent Conversion Fold Improvement (Relative to SEQ ID NO: 466)[1] |
|---|---|---|
| 473/474 | V71A; L88A; V94L; T133H | + |
| 475/476 | V71A; T133H | ++ |
| 477/478 | T133H | + |

[1]Levels of increased activity were determined relative to the reference polypeptide of SEQ ID NO: 466 and defined as follows: "+" 1.25 to 1.50, "++" >1.50

TABLE 6.2

| Analytical Method | |
|---|---|
| Instrument | ThermoScientific U3000 UPLC with UV Detection |
| Column | Atlantis T3 C18, 3 μm, 2.1 × 100 mm |
| Mobile Phase | Isocratic 75:25 water with 0.1% TFA: acetonitrile with 0.1% TFA |
| Flow Rate | 0.3 mL/min |
| Run Time | 1.6 min |

TABLE 6.2-continued

| Analytical Method | |
|---|---|
| Substrate and Product Elution order | F-adenine: 0.92 min F-adenosine 1.12 min |
| Column Temperature | 40° C. |
| Injection Volume | 10 μL |
| Detection | UV 265 nm Detector: Thermo VWD-3400; Peak width 0.02 min; Collection rate = 200 Hz; Time Constant = 0.12 s |

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (484 sequences)

SEQ ID NO: 1 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 2 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 3 - DNA, 774 bp, Artificial Sequence
  Variant of Deoxyribose Phosphate Aldolase From Shewanella Halifaxensis
atgagcgatctgaagaaagcggcgcagcaggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatacccttctgaaggtgatcattgaaaccggcgtactggccgacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatatctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 4 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAIMIYPRFIPIARKTLNEIGGDDIKIATVTNFPHGNDDIAIAVLETRAAVAYGADEVDVVFPYRALMEGNETVGFELVKACKEACGEDTLLKVIIETGVLADPALIRKASELSIDAGADFIKTSTGKVAVNATLEAAEIMMTVISEKNPKVGFKPAGGVKDAAAAAEYLGVAARLLGDDWATPATFRFGASSLLTNLLHTLELADAPQGAQGY

SEQ ID NO: 5 - DNA, 774 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 6 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 7 - DNA, 774 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcgatgacatcaaaattgcgaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagcggcgtactggccgacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 8 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGDDIKIATVTNFPHGNDDIAIAVAETRAAVAYGADEVDVVFPYRALMEGNETVGFELVKACKEACGEDTILKVIIESGVLADPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 9 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatacccttctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 10 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTLLKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 11 - DNA, 774 bp, Artificial Sequence
  Variant of Deoxyribose Phosphate Aldolase From Shewanella Halifaxensis
atgagcgatctgaagaaagcggcgcagcaggcgattagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggacgtggttttcccgtatcgtgcgctgatggcaggtaacgaaaccgtgggctttgagctggttaaggcgtgcaaagaggcgtgcggtgaagatacccttctgaaggtgatcattgaaaccggcgaactgaaagacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatatctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 12 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGPDIKIATVTNFPHGNDDIAIAVAETRAAVAYGADEVDVVFPYRALMAGNETVGFELVKACKEACGEDTLLKVIIETGELKDPALIRKASELSIDAGADFIKTSTGKVAVNATLEAAEIMMTVISEKNPKVGFKPAGGVKDAAAAAEYLGVAARLLGDDWATPATFRFGASSLLTNLLHTLELADAPQGAQGY

SEQ ID NO: 13 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggctctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 14 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGSDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 15 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 16 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 17 - DNA, 774 bp, Artificial Sequence
  Variant of Deoxyribose Phosphate Aldolase From Shewanella Halifaxensis
atgagcgatctgaagtatgcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 18 - protein, 257 aa, Artificial Sequence
  Variant of Deoxyribose Phosphate Aldolase From Shewanella Halifaxensis
MSDLKYAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 19 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 20 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGPDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 21 - DNA, 774 bp, Artificial Sequence
  Variant of Deoxyribose Phosphate Aldolase From Shewanella Halifaxensis
atgagcgatctgaagcatgcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 22 - protein, 257 aa, Artificial Sequence
  Variant of Deoxyribose Phosphate Aldolase From Shewanella Halifaxensis
MSDLKHAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 23 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcactgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgtggtgaagataccatcctgaaggtgatcattgaaagcggcgttctggcggacccggcgctgattcgtaaagcgagcgaactgagtatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 24 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGTDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 25 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcgaaggcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 26 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAKAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 27 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgcgtgagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 28 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVRETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 29 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgtgtgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 30 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIACVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 31 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttacggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 32 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVTVNATLEAAEIMMTVISEKNPKVGFKPAGGVKDAAAAAEFLGVAARLLGDDWATPATFRFGASSLLTNLLHTLELADAPQGAQGY

SEQ ID NO: 33 - DNA, 774 bp, Artificial Sequence
  Variant of Deoxyribose Phosphate Aldolase From Shewanella Halifaxensis
atgagcgatctgaagaaagcggcgcagcaagcgatcaggctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 34 - protein, 257 aa, Artificial Sequence
  Variant of Deoxyribose Phosphate Aldolase From Shewanella Halifaxensis
MSDLKKAAQQAIRLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 35 - DNA, 774 bp, Artificial Sequence
  Variant of Deoxyribose Phosphate Aldolase From Shewanella Halifaxensis
atgagcgatctgaagtgggcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 36 - protein, 257 aa, Artificial Sequence
  Variant of Deoxyribose Phosphate Aldolase From Shewanella Halifaxensis
MSDLKWAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 37 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatgcttggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 38 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMLGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 39 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatgcatggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 40 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMHGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 41 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctgcgtgacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 42 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLRDPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 43 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggtggacccggcgctgattcgtaaagcgagcgaactgagcatcgatgcgggtgcggacttcattaagaccagcaccggcaaagttagggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 44 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLVDPALIRKASELSIDAGADFIKTSTGKVRVNATLEAAEIMMTVISEKNPKVGFKPAGGVKDAAAAAEFLGVAARLLGDDWATPATFRFGASSLLTNLLHTLELADAPQGAQGY

SEQ ID NO: 45 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgagtccggcgaccttccgttttggtgcgagcagcctgctgaccaacctgctgcacaccctggaactggcggacgcgccgcagggtgcgcaaggctattaa

SEQ ID NO: 46 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWASPATFRFGASSLLTNLLHTLELADAPQGAQGY

SEQ ID NO: 47 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatcttatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 48 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDLILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 49 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggaggtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 50 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVEVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 51 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgatctgctgaccaacctgctgcacaccctggaactggcggacgcgccgcagggtgcgcaaggctattaa

SEQ ID NO: 52 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASDLLTNLLHTLELADAPQGAQGY

SEQ ID NO: 53 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatgcgtggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 54 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMRGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 55 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcgatggcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 56 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAMAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 57 - DNA, 774 bp, Artificial Sequence
  Variant of Deoxyribose Phosphate Aldolase From Shewanella Halifaxensis
atgagcgatctgaagaaagcggcgcgtcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 58 - protein, 257 aa, Artificial Sequence
  Variant of Deoxyribose Phosphate Aldolase From Shewanella Halifaxensis
MSDLKKAARQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 59 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgacgagcctgctgaccaacctgctgcacaccctggaactggcggacgcgccgcagggtgcgcaaggctattaa

SEQ ID NO: 60 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGATSLLTNLLHTLELADAPQGAQGY

SEQ ID NO: 61 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 62 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIIMTVISEKNPKVGFKPAGGVKDAAAAAEFLGVAARLLGDDWATPATFRFGASSLLTNLLHTLELADAPQGAQGY

SEQ ID NO: 63 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacagtgcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 64 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADSALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 65 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgtgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 66 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIVTVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 67 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 68 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGMKPAGGVKDAAAAAEFLGVAARLLGDDWATPATFRFGASSLLTNLLHTLELADAPQGAQGY

SEQ ID NO: 69 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctggggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 70 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAGAAAEFLGVAARLLGDDWATPATFRFGASSLLTNLLHTLELADAPQGAQGY

SEQ ID NO: 71 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatgatgggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 72 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMMGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 73 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccgtgctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 74 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTVLKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 75 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggccttgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 76 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGLDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 77 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacgcggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 78 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADAALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 79 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacaaggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 80 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADKALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 81 - DNA, 774 bp, Artificial Sequence
  Variant of Deoxyribose Phosphate Aldolase From Shewanella Halifaxensis
atgtgtgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 82 - protein, 257 aa, Artificial Sequence
  Variant of Deoxyribose Phosphate Aldolase From Shewanella Halifaxensis
MCDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 83 - DNA, 774 bp, Artificial Sequence
  Variant of Deoxyribose Phosphate Aldolase From Shewanella Halifaxensis
atgcgtgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 84 - protein, 257 aa, Artificial Sequence
  Variant of Deoxyribose Phosphate Aldolase From Shewanella Halifaxensis
MRDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 85 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcattgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 86 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGIDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 87 - DNA, 774 bp, Artificial Sequence
  Variant of Deoxyribose Phosphate Aldolase From Shewanella Halifaxensis
atgagcgatctgaagaaagcggcgcagcaagcgatccagctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 88 - protein, 257 aa, Artificial Sequence
  Variant of Deoxyribose Phosphate Aldolase From Shewanella Halifaxensis
MSDLKKAAQQAIQLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 89 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgactgagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 90 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVTETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 91 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcggtgtgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 92 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAVCIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 93 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 94 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAIVIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 95 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattctgctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 96 - protein, 257 aa, Artificial Sequence
  Variant of Deoxyribose Phosphate Aldolase From Shewanella Halifaxensis
MSDLKKAAQQAISLMDLTTLNDDDTDQKVILLCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 97 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaacctgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 98 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNEPVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 99 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgtcacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcgcttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 100 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAALAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 101 - DNA, 774 bp, Artificial Sequence
  Variant of Deoxyribose Phosphate Aldolase From Shewanella Halifaxensis
atgtgggatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 102 - protein, 257 aa, Artificial Sequence
  Variant of Deoxyribose Phosphate Aldolase From Shewanella Halifaxensis
MWDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 103 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctgtgtgacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 104 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLCDPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 105 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 106 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMKGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 107 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattgctgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 108 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVIAEKNPKVGFKPAGGVKDAAAAAEFLGVAARLLGDDWATPATFRFGASSLLTNLLHTLELADAPQGAQGY

SEQ ID NO: 109 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggttgtaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 110 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGCKPAGGVKDAAAAAEFLGVAARLLGDDWATPATFRFGASSLLTNLLHTLELADAPQGAQGY

SEQ ID NO: 111 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttcctgttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 112 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVPVNATLEAAEIMMTVISEKNPKVGFKPAGGVKDAAAAAEFLGVAARLLGDDWATPATFRFGASSLLTNLLHTLELADAPQGAQGY

SEQ ID NO: 113 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatatgatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 114 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDMILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 115 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 116 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGIKDAAAAAEFLGVAARLLGDDWATPATFRFGASSLLTNLLHTLELADAPQGAQGY

SEQ ID NO: 117 - DNA, 774 bp, Artificial Sequence
  Variant of Deoxyribose Phosphate Aldolase From Shewanella Halifaxensis
atgagcgatctgaagaaagcggcgcagcaagcgatccttctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 118 - protein, 257 aa, Artificial Sequence
  Variant of Deoxyribose Phosphate Aldolase From Shewanella Halifaxensis
MSDLKKAAQQAILLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 119 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaggggtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 120 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNEGVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 121 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagctgtctgctgaccaacctgctgcacaccctggaactggcggacgcgccgcagggtgcgcaaggctattaa

SEQ ID NO: 122 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASCLLTNLLHTLELADAPQGAQGY

SEQ ID NO: 123 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 124 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAIMIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 125 - DNA, 774 bp, Artificial Sequence
  Variant of Deoxyribose Phosphate Aldolase From Shewanella Halifaxensis
atgagcgatctgaagaaagcggcgcagcaagcgatcattctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 126 - protein, 257 aa, Artificial Sequence
  Variant of Deoxyribose Phosphate Aldolase From Shewanella Halifaxensis
MSDLKKAAQQAIILMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 127 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattcgggagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 128 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVIREKNPKVGFKPAGGVKDAAAAAEFLGVAARLLGDDWATPATFRFGASSLLTNLLHTLELADAPQGAQGY

SEQ ID NO: 129 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtgacgttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 130 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVTFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 131 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgactctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctattaa

SEQ ID NO: 132 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGADSLLTNLLHTLELADAPQGAQGY

SEQ ID NO: 133 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatatcatcctgaaggtgatcattgaaagcggcgttctggcggacccggcgctgattcgtaaagcgagcgaactgagcatcgatgcgggtgcggacttcattaagaccagcaccggcaaagttgtagtgaacgcgactctggaggcggcggaaatcatgatgaccgttattagcgagaagaacccgaaagtgggtttcaagccggcgggtggcgttacagatgctgcggcggcggcggaatttctgggtgtggcggcgcgtctgctgggcgatgactgggcgaccccggcgaccttccgttttggtgcggatcatctgctgaccaacctgctgcacaccctggaactggcggacgcgccgcagggtgcgcaaggctattaa

SEQ ID NO: 134 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDIILKVIIESGVLADPALIRKASELSIDAGADFIKTSTGKVVVNATLEAAEIMMTVISEKNPKVGFKPAGGVTDAAAAAEFLGVAARLLGDDWATPATFRFGADHLLTNLLHTLELADAPQGAQGY

SEQ ID NO: 135 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcggatcgtctgctgaccaacctgctgcacaccctggaactggcggacgcgccgcagggtgcgcaaggctattaa

SEQ ID NO: 136 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVKDAAAAAEFLGVAARLLGDDWATPATFRFGADRLLTNLLHTLELADAPQGAQGY

SEQ ID NO: 137 - DNA, 774 bp, Artificial Sequence
  Variant of Deoxyribose Phosphate Aldolase From Shewanella Halifaxensis
atgagcgatctgaagaaagcggcgcagcaagcgatcagcctgatggatctgaccaccctgaacgacgatgacaccgaccagaaagtgattgagctgtgccacaaagcgaaaaccccggcgggtgacaccgcggcgatctgcatttacccgcgtttcatcccgattgcgcgtaagaccctgaacgaaatcggtggcgatgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccatcctgaaggtgatcattgaaagcggcgttctggcggacccggcgctgattcgtaaagcgagcgaactgagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttacagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 138 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAICIYPRFIPIARKTLNEIGGDDIKIATVTNFPHGNDDIAIAVLETRAAVAYGADEVDVVFPYRALMEGNETVGFELVKACKEACGEDTILKVIIESGVLADPALIRKASELSIDAGADFIKTSTGKVAVNATLEAAEIMMTVISEKNPKVGFKPAGGVTDAAAAAEFLGVAARLLGDDWATPATFRFGASSLLTNLLHTLELADAPQGAQGY

SEQ ID NO: 139 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatgaagggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 140 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAALAYGADEVDVVFPYRALMKGNETVGFELVKACKEACGEDLILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 141 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggagggtaacgaaaccgtgggctttgagctggttaaggcgtgcaaagaggcgtgcggtgaagatacgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 142 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGSDIKIATVTNFPHGNDDIAIAVLETRAALAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 143 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 144 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAVMIYPRFIPIARKTLNEIGGSDIKIATVTNFPHGNDDIAIAVLETRAALAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 145 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatctgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 146 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGSDIKIATVTNFPHGNDDIAIAVLETRAAVAYGADEVDVVFPYRALMKGNETVGFELVKACKEACGEDLLLKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 147 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggagggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 148 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAALAYGADEVDVVFPYRALMEGNETVGFELVKACKEACGEDLILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 149 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatgaagggtaacgaaaccgtgggctttgagctggttaaggcgtgcaaagaggcgtgcggtgaagatctgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttgtaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 150 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMKGNETVGFELVKACKEACGEDLLLKVIIETGVLKDPALIRKASEISIDAGADFIKTSTGKVAVNATLEAAEIMMTVISEKNPKVGCKPAGGVKDAAAAAEFLGVAARLLGDDWATPATFRFGASSLLTNLLHTLELADAPQGAQGY

SEQ ID NO: 151 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatacgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttgtaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 152 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMKGNETVGFELVKACKEACGEDTLLKVIIETGVLKDPALIRKASEISIDAGADFIKTSTGKVAVNATLEAAEIMMTVISEKNPKVGCKPAGGVKDAAAAAEFLGVAARLLGDDWATPATFRFGASSLLTNLLHTLELADAPQGAQGY

SEQ ID NO: 153 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatgaagggtaacgaaaccgtgggctttgagctggttaaggcgtgcaaagaggcgtgcggtgaagatacgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 154 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAALAYGADEVDVVFPYRALMKGNETVGFELVKACKEACGEDTILKVIIETGVLKDPALIRKASEISIDAGADFIKTSTGKVAVNATLEAAEIVMTVISEKNPKVGFKPAGGVTDAAAAAEFLGVAARLLGDDWATPATFRFGASSLLTNLLHTLELADAPQGAQGY

SEQ ID NO: 155 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggagggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 156 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGPDIKIATVTNFPHGNDDIAIAVLETRAALAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVTDAAAAAEFLGVAARLLGDDWATPATFRFGASSLLTNLLHTLELADAPQGAQGY

SEQ ID NO: 157 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatacgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttttaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 158 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAVMIYPRFIPIARKTLNEIGGPDIKIATVTNFPHGNDDIAIAVLETRAAVAYGADEVDVVFPYRALMKGNETVGFELVKACKEACGEDTLLKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 159 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatgatgggtaacgaaaccgtgggctttgagctggttaaggcgtgcaaagaggcgtgcggtgaagatatgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 160 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAALAYGADEVDVVFPYRALMMGNETVGFELVKACKEACGEDMILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 161 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatgatgggtaacgaaaccgtgggctttgagctggttaaggcgtgcaaagaggcgtgcggtgaagatacgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttgtaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 162 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAALAYGADEVDVVFPYRALMMGNETVGFELVKACKEACGEDTILKVIIETGVLKDPALIRKASEISIDAGADFIKTSTGKVAVNATLEAAEIVMTVISEKNPKVGCKPAGGVKDAAAAAEFLGVAARLLGDDWATPATFRFGASSLLTNLLHTLELADAPQGAQGY

SEQ ID NO: 163 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggagggtaacgaaaccgtgggctttgagctggttaaggcgtgcaaagaggcgtgcggtgaagatatgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 164 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGPDIKIATVTNFPHGNDDIAIAVLETRAALAYGADEVDVVFPYRALMEGNETVGFELVKACKEACGEDMILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 165 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggagggtaacgaaaccgtgggctttgagctggttaaggcgtgcaaagaggcgtgcggtgaagatctgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 166 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGSDIKIATVTNFPHGNDDIAIAVLETRAAVAYGADEVDVVFPYRALMEGNETVGFELVKACKEACGEDLLLKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 167 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 168 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 169 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggaaggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 170 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAVMIYPRFIPIARKTLNEIGGPDIKIATVTNFPHGNDDIAIAVLETRAAVAYGADEVDVVFPYRALMEGNETVGFELVKACKEACGEDLILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 171 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatctgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttttaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 172 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGPDIKIATVTNFPHGNDDIAIAVLETRAAVAYGADEVDVVFPYRALMKGNETVGFELVKACKEACGEDLLLKVIIETGVLKDPALIRKASEISIDAGADFIKTSTGKVAVNATLEAAEIMMTVISEKNPKVGFKPAGGVTDAAAAAEFLGVAARLLGDDWATPATFRFGASSLLTNLLHTLELADAPQGAQGY

SEQ ID NO: 173 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatatgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttgtaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 174 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGSDIKIATVTNFPHGNDDIAIAVLETRAAVAYGADEVDVVFPYRALMEGNETVGFELVKACKEACGEDMILKVIIETGVLKDPALIRKASEISIDAGADFIKTSTGKVAVNATLEAAEIMMTVISEKNPKVGCKPAGGVKDAAAAAEFLGVAARLLGDDWATPATFRFGASSLLTNLLHTLELADAPQGAQGY

SEQ ID NO: 175 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatacgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 176 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGSDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 177 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 178 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVTDAAAAAEFLGVAARLLGDDWATPATFRFGASSLLTNLLHTLELADAPQGAQGY

SEQ ID NO: 179 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttgtaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 180 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGCKPAGGVTDAAAAAEFLGVAARLLGDDWATPATFRFGASSLLTNLLHTLELADAPQGAQGY

SEQ ID NO: 181 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 182 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMKGNETVGFELVKACKEACGEDLILKVIIETGVLKDPALIRKASEISIDAGADFIKTSTGKVAVNATLEAAEIVMTVISEKNPKVGFKPAGGVTDAAAAAEFLGVAARLLGDDWATPATFRFGASSLLTNLLHTLELADAPQGAQGY

SEQ ID NO: 183 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatacgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttgtaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 184 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMKGNETVGFELVKACKEACGEDTLLKVIIETGVLKDPALIRKASEISIDAGADFIKTSTGKVAVNATLEAAEIMMTVISEKNPKVGCKPAGGVKDAAAAAEFLGVAARLLGDDWATPATFRFGASSLLTNLLHTLELADAPQGAQGY

SEQ ID NO: 185 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 186 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGPDIKIATVTNFPHGNDDIAIAVLETRAALAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 187 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatacgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 188 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 189 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttgtaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 190 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMEGNETVGFELVKACKEACGEDLILKVIIETGVLKDPALIRKASEISIDAGADFIKTSTGKVAVNATLEAAEIMMTVISEKNPKVGCKPAGGVKDAAAAAEFLGVAARLLGDDWATPATFRFGASSLLTNLLHTLELADAPQGAQGY

SEQ ID NO: 191 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatgatgggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttgtaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 192 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMMGNETVGFELVKACKEACGEDLILKVIIETGVLKDPALIRKASEISIDAGADFIKTSTGKVAVNATLEAAEIMMTVISEKNPKVGCKPAGGVKDAAAAAEFLGVAARLLGDDWATPATFRFGASSLLTNLLHTLELADAPQGAQGY

SEQ ID NO: 193 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 194 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGSDIKIATVTNFPHGNDDIAIAVLETRAALAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 195 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgatgggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 196 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMMGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 197 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggagggtaacgaaaccgtgggctttgagctggttaaggcgtgcaaagaggcgtgcggtgaagatacgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 198 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAVMIYPRFIPIARKTLNEIGGSDIKIATVTNFPHGNDDIAIAVLETRAALAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVTDAAAAAEFLGVAARLLGDDWATPATFRFGASSLLTNLLHTLELADAPQGAQGY

SEQ ID NO: 199 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatatgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 200 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMKGNETVGFELVKACKEACGEDMLLKVIIETGVLKDPALIRKASEISIDAGADFIKTSTGKVAVNATLEAAEIVMTVISEKNPKVGFKPAGGVTDAAAAAEFLGVAARLLGDDWATPATFRFGASSLLTNLLHTLELADAPQGAQGY

SEQ ID NO: 201 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggaaggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 202 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDLILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 203 - DNA, 774 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggagggtaacgaaaccgtgggctttgagctggttaaggcgtgcaaagaggcgtgcggtgaagatctgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctattaa

SEQ ID NO: 204 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAVMIYPRFIPIARKTLNEIGGSDIKIATVTNFPHGNDDIAIAVLETRAAVAYGADEVDVVFPYRALMEGNETVGFELVKACKEACGEDLLLKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 205 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggagggtaacgaaaccgtgggctttgagctggttaaggcgtgcaaagaggcgtgcggtgaagatatgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 206 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDMLLKVIIETGVLKDPALIRKASEISIDAGADFIKTSTGKVAVNATLEAAEIMMTVISEKNPKVGFKPAGGVTDAAAAAEFLGVAARLLGDDWATPATFRFGASSLLTNLLHTLELADAPQGAQGY

SEQ ID NO: 207 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggagggtaacgaaaccgtgggctttgagctggttaaggcgtgcaaagaggcgtgcggtgaagatatgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 208 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGPDIKIATVTNFPHGNDDIAIAVLETRAAVAYGADEVDVVFPYRALMEGNETVGFELVKACKEACGEDMILKVIIETGVLKDPALIRKASEISIDAGADFIKTSTGKVAVNATLEAAEIMMTVISEKNPKVGFKPAGGVTDAAAAAEFLGVAARLLGDDWATPATFRFGASSLLTNLLHTLELADAPQGAQGY

SEQ ID NO: 209 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatggagggtaacgaaaccgtgggctttgagctggttaaggcgtgcaaagaggcgtgcggtgaagatacgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 210 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAALAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 211 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatatgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 212 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDMLLKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 213 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 214 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 215 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatatgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 216 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMKGNETVGFELVKACKEACGEDMLLKVIIETGVLKDPALIRKASEISIDAGADFIKTSTGKVAVNATLEAAEIMMTVISEKNPKVGFKPAGGVTDAAAAAEFLGVAARLLGDDWATPATFRFGASSLLTNLLHTLELADAPQGAQGY

SEQ ID NO: 217 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 218 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAVMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 219 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatgaagggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 220 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMKGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 221 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggagggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 222 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVTDAAAAAEFLGVAARLLGDDWATPATFRFGASSLLTNLLHTLELADAPQGAQGY

SEQ ID NO: 223 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatacgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 224 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTLLKVIIETGVLKDPALIRKASEISIDAGADFIKTSTGKVAVNATLEAAEIMMTVISEKNPKVGFKPAGGVTDAAAAAEFLGVAARLLGDDWATPATFRFGASSLLTNLLHTLELADAPQGAQGY

SEQ ID NO: 225 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaagggtaacgaaaccgtgggctttgagctggttaaggcgtgcaaagaggcgtgcggtgaagatatgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 226 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMKGNETVGFELVKACKEACGEDMLLKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 227 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatatgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttttaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 228 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAVMIYPRFIPIARKTLNEIGGPDIKIATVTNFPHGNDDIAIAVLETRAAVAYGADEVDVVFPYRALMEGNETVGFELVKACKEACGEDMILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 229 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttttaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 230 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 231 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggagggtaacgaaaccgtgggctttgagctggttaaggcgtgcaaagaggcgtgcggtgaagatatgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 232 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDMLLKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 233 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcgctggcgtacggcgcggatgaagtggacgtggttttcccgtatcgtgcgctgatgaagggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 234 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGSDIKIATVTNFPHGNDDIAIAVLETRAALAYGADEVDVVFPYRALMKGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 235 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatatgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 236 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMEGNETVGFELVKACKEACGEDMILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 237 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggcccggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatgatgggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggttttaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 238 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGPDIKIATVTNFPHGNDDIAIAVLETRAAVAYGADEVDVVFPYRALMMGNETVGFELVKACKEACGEDLILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 239 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcgattatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatatgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttacggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 240 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAIMIYPRFIPIARKTLNEIGGSDIKIATVTNFPHGNDDIAIAVLETRAAVAYGADEVDVVFPYRALMEGNETVGFELVKACKEACGEDMLLKVIIETGVLKDPALIRKASEISIDAGADFIKTSTGKVAVNATLEAAEIVMTVISEKNPKVGFKPAGGVTDAAAAAEFLGVAARLLGDDWATPATFRFGASSLLTNLLHTLELADAPQGAQGY

SEQ ID NO: 241 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggagggtaacgaaaccgtgggctttgagctggttaaggcgtgcaaagaggcgtgcggtgaagatctgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttgtaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 242 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGSDIKIATVTNFPHGNDDIAIAVLETRAAVAYGADEVDVVFPYRALMEGNETVGFELVKACKEACGEDLILKVIIETGVLKDPALIRKASEISIDAGADFIKTSTGKVAVNATLEAAEIVMTVISEKNPKVGCKPAGGVKDAAAAAEFLGVAARLLGDDWATPATFRFGASSLLTNLLHTLELADAPQGAQGY

SEQ ID NO: 243 - DNA, 771 bp, Artificial Sequence
  Variant of Deoxyribose Phosphate Aldolase From Shewanella Halifaxensis
atgagcgatctgaagaaagcggcgcagcgggcgattatcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggtggcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggtttcaagccggcgggtggcgttaaggatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 244 - protein, 257 aa, Artificial Sequence
  Variant of Deoxyribose Phosphate Aldolase From Shewanella Halifaxensis
MSDLKKAAQRAIILMDLTTLNDDDTDQKVIELCHKAKTPAGDTAAVMIYPRFIPIARKTLNEIGGSDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIVMTVISEKNPKVGFKPAGGVKDAAAAAEFLGVAARLLGDDWATPATFRFGASSLLTNLLHTLELADAPQGAQGY

SEQ ID NO: 245 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcggttatgatttacccgcgtttcatcccgattgcgcgtaagaccctgaacgaaatcggtggctcggacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatacgctgctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcgtgatgaccgttattagcgagaagaacccgaaagtgggttgtaagccggcgggtggcgttacggatgctgcggcggcggcggaatttctgggtgtggcggcgcgcctgctgggcgatgactgggcgaccccggcgaccttccgttttggtgcgagcagcctgctgaccaacctgctgcacaccctggaactggcggacgcgccgcagggtgcgcaaggctat

SEQ ID NO: 246 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAVMIYPRFIPIARKTLNEIGGSDIKIATVTNFPHGNDDIAIAVLETRAAVAYGADEVDVVFPYRALMEGNETVGFELVKACKEACGEDTLLKVIIETGVLKDPALIRKASEISIDAGADFIKTSTGKVAVNATLEAAEIVMTVISEKNPKVGCKPAGGVTDAAAAAEFLGVAARLLGDDWATPATFRFGASSLLTNLLHTLELADAPQGAQGY

SEQ ID NO: 247 - DNA, 771 bp, Artificial Sequence
  Variant of Deoxyribose Phosphate Aldolase From Shewanella Halifaxensis
atgagcgatctgaagaaagcggcgaagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 248 - protein, 257 aa, Artificial Sequence
  Variant of Deoxyribose Phosphate Aldolase From Shewanella Halifaxensis
MSDLKKAAKRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 249 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgttaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 250 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNVTVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 251 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccgggtctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 252 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPGLIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 253 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgataccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 254 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNDTVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 255 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatttgattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 256 - protein, 257 aa, Artificial Sequence; identical to SEQ ID NO: 202
  Variant of Deoxyribose Phosphate Aldolase From Shewanella Halifaxensis

SEQ ID NO: 257 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaacatgcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 258 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKHACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 259 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagttgcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 260 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKVACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 261 - DNA, 771 bp, Artificial Sequence
  Variant of Deoxyribose Phosphate Aldolase From Shewanella Halifaxensis
atgagcgatctgcggaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 262 - protein, 257 aa, Artificial Sequence
  Variant of Deoxyribose Phosphate Aldolase From Shewanella Halifaxensis
MSDLRKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 263 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccgtggggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 264 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPWGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 265 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttaggctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 266 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFRLVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 267 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaaggtgcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 268 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKGACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 269 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaaactgcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 270 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKTACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 271 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttatgctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 272 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFMLVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 273 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgacgagcctgctgaccaacctgctgcacaccctggaactggcggacgcgccgcagggtgcgcaaggctat

SEQ ID NO: 274 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGATSLLTNLLHTLELADAPQGAQGY

SEQ ID NO: 275 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacatttgtattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 276 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDICIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 277 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgtgtggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 278 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMCGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 279 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatgggattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 280 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDGILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 281 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatcggattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 282 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDRILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 283 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccggaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 284 - protein, 257 aa, Artificial Sequence
  Variant of Deoxyribose Phosphate Aldolase From Shewanella Halifaxensis
MSDLKKAAQRAISLMDLTTLNDDDTDRKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 285 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgtctctgctgggcgatgactgggcgaccccggcgaccttccgttttggtgcgagcagcctgctgaccaacctgctgcacaccctggaactggcggacgcgccgcagggtgcgcaaggctat

SEQ ID NO: 286 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAASLLGDDWATPATFRFGASSLLTNLLHTLELADAPQGAQGY

SEQ ID NO: 287 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgcatgagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 288 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVHETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 289 - DNA, 771 bp, Artificial Sequence
  Variant of Deoxyribose Phosphate Aldolase From Shewanella Halifaxensis
atgagcgatctgaagaaagcggcgcagcgggcgattcttctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 290 - protein, 257 aa, Artificial Sequence
  Variant of Deoxyribose Phosphate Aldolase From Shewanella Halifaxensis
MSDLKKAAQRAILLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 291 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaaagggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 292 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKRACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 293 - DNA, 771 bp, Artificial Sequence
  Variant of Deoxyribose Phosphate Aldolase From Shewanella Halifaxensis
atgagcgatctgaagaaagcggcgcttcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 294 - protein, 257 aa, Artificial Sequence
  Variant of Deoxyribose Phosphate Aldolase From Shewanella Halifaxensis
MSDLKKAALRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 295 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacctgatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 296 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNLIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 297 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtcgtgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 298 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGRETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 299 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaacagccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 300 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKQPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 301 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaattggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 302 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKLACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 303 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatgaatggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 304 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMNGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 305 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggctgtgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 306 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGCDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 307 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaactgaccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 308 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGELTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 309 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgctgggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 310 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVALGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 311 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcgctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 312 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGADIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 313 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtggtggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 314 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVVETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 315 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccgctgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 316 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPLLIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 317 - DNA, 771 bp, Artificial Sequence
  Variant of Deoxyribose Phosphate Aldolase From Shewanella Halifaxensis
atgagcgatctgaagaaagcggcgcagcgggcgattacgctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagtatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 318 - protein, 257 aa, Artificial Sequence
  Variant of Deoxyribose Phosphate Aldolase From Shewanella Halifaxensis
MSDLKKAAQRAITLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 319 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattctgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 320 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDILIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 321 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccatgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 322 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGHDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 323 - DNA, 771 bp, Artificial Sequence
  Variant of Deoxyribose Phosphate Aldolase From Shewanella Halifaxensis
atgaatgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 324 - protein, 257 aa, Artificial Sequence
  Variant of Deoxyribose Phosphate Aldolase From Shewanella Halifaxensis
MNDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 325 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatcatattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 326 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDHILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASSLLTNLLHTLELADAPQGAQGY

SEQ ID NO: 327 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 328 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVAETRAAVAYGADEVEVVFPYRALMEGNETVGFELVKACKEACGEDTILKVIIESGVLKDPALIRKASEISIDAGADFIKTSTGKVAVNATLEAAEIMMTVISEKNPKVGFKPAGGVKDAAAAAEFLGVAARLLGDDWATPATFRFGATDLLTNLLHTLELADAPQGAQGY

SEQ ID NO: 329 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgacctcgctgctgaccaacctgctgcacaccctggaactggcggacgcgccgcagggtgcgcaaggctat

SEQ ID NO: 330 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIVTVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGATSLLTNLLHTLELADAPQGAQGY

SEQ ID NO: 331 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 332 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIIMTVISEKNPKVGFKPAGGVKDAAAAAEFLGVAARLLGDDWATPATFRFGASSLLTNLLHTLELADAPQGAQGY

SEQ ID NO: 333 - DNA, 771 bp, Artificial Sequence
  Variant of Deoxyribose Phosphate Aldolase From Shewanella Halifaxensis
atgagcgatctgaagcatgcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 334 - protein, 257 aa, Artificial Sequence
  Variant of Deoxyribose Phosphate Aldolase From Shewanella Halifaxensis
MSDLKHAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGATDLLTNLLHTLELADAPQGAQGY

SEQ ID NO: 335 - DNA, 771 bp, Artificial Sequence
  Variant of Deoxyribose Phosphate Aldolase From Shewanella Halifaxensis
atgagtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 336 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIVTVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGASSLLTNLLHTLELADAPQGAQGY

SEQ ID NO: 337 - DNA, 771 bp, Artificial Sequence
  Variant of Deoxyribose Phosphate Aldolase From Shewanella Halifaxensis
atgagtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 338 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVEVVFPYRALMEGNETVGFELVKACKEACGEDTILKVIIETGVLKDPALIRKASEISIDAGADFIKTSTGKVAVNATLEAAEIMMTVISEKNPKVGMKPAGGVKDAAAAAEFLGVAARLLGDDWATPATFRFGADSLLTNLLHTLELADAPQGAQGY

SEQ ID NO: 339 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 340 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGADSLLTNLLHTLELADAPQGAQGY

SEQ ID NO: 341 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcctggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 342 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGLDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGADSLLTNLLHTLELADAPQGAQGY

SEQ ID NO: 343 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 344 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASDLLTNLLHTLELADAPQGAQGY

SEQ ID NO: 345 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgacctcgctgctgaccaacctgctgcacaccctggaactggcggacgcgccgcagggtgcgcaaggctat

SEQ ID NO: 346 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGLDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGATSLLTNLLHTLELADAPQGAQGY

SEQ ID NO: 347 - DNA, 771 bp, Artificial Sequence
  Variant of Deoxyribose Phosphate Aldolase From Shewanella Halifaxensis
atgagtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcggatgacctgctgaccaacctgctgcacaccctggaactggcggacgcgccgcagggtgcgcaaggctat

SEQ ID NO: 348 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGMKPAGGVKDAAAAAEFLGVAARLLGDDWATPATFRFGADDLLTNLLHTLELADAPQGAQGY

SEQ ID NO: 349 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcggatgacctgctgaccaacctgctgcacaccctggaactggcggacgcgccgcagggtgcgcaaggctat

SEQ ID NO: 350 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIMMTVISEKNPKVGFKPAGGIKDAAAAAEFLGVAARLLGDDWATPATFRFGADDLLTNLLHTLELADAPQGAQGY

SEQ ID NO: 351 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgagctcgctgctgaccaacctgctgcacaccctggaactggcggacgcgccgcagggtgcgcaaggctat

SEQ ID NO: 352 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIMMTVISEKNPKVGMKPAGGVKDAAAAAEFLGVAARLLGDDWATPATFRFGASSLLTNLLHTLELADAPQGAQGY

SEQ ID NO: 353 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 354 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGASDLLTNLLHTLELADAPQGAQGY

SEQ ID NO: 355 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcctggacatcaaaattgccaccgttaccaactttccgcacggtaacgatgacattgcgattgcggtgttggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcggatgacctgctgaccaacctgctgcacaccctggaactggcggacgcgccgcagggtgcgcaaggctat

SEQ ID NO: 356 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGLDIKIATVTNFPHGNDDIAIAVLETRAAVAYGADEVEVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGADDLLTNLLHTLELADAPQGAQGY

SEQ ID NO: 357 - DNA, 771 bp, Artificial Sequence
  Variant of Deoxyribose Phosphate Aldolase From Shewanella Halifaxensis
atgcgtgatctgaagaaggcggcgcagcaggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 358 - protein, 257 aa, Artificial Sequence
  Variant of Deoxyribose Phosphate Aldolase From Shewanella Halifaxensis
MRDLKKAAQQAISLMDLTTLNDDDTDQKVIELCHKAKTPAGDTAAIMIYPRFIPIARKTLNEIGGPDIKIATVTNFPHGNDDIAIAVLETRAAVAYGADEVEVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGATDLLTNLLHTLELADAPQGAQGY

SEQ ID NO: 359 - DNA, 771 bp, Artificial Sequence
  Variant of Deoxyribose Phosphate Aldolase From Shewanella Halifaxensis
atgagcgatctgaagaaggcggcgcagcaggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 360 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAIVIYPRFIPIARKTLNEIGGLDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGATDLLTNLLHTLELADAPQGAQGY

SEQ ID NO: 361 - DNA, 771 bp, Artificial Sequence
  Variant of Deoxyribose Phosphate Aldolase From Shewanella Halifaxensis
atgagtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 362 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGASDLLTNLLHTLELADAPQGAQGY

SEQ ID NO: 363 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 364 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGATDLLTNLLHTLELADAPQGAQGY

SEQ ID NO: 365 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 366 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVEVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGATDLLTNLLHTLELADAPQGAQGY

SEQ ID NO: 367 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 368 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIVTVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIIMTVISEKNPKVGFKPAGGIKDAAAAAEFLGVAARLLGDDWATPATFRFGADSLLTNLLHTLELADAPQGAQGY

SEQ ID NO: 369 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 370 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGLDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGMKPAGGVKDAAAAAEFLGVAARLLGDDWATPATFRFGASDLLTNLLHTLELADAPQGAQGY

SEQ ID NO: 371 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 372 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGLDIKIATVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIMMTVISEKNPKVGFKPAGGVKDAAAAAEFLGVAARLLGDDWATPATFRFGATDLLTNLLHTLELADAPQGAQGY

SEQ ID NO: 373 - DNA, 771 bp, Artificial Sequence
  Variant of Deoxyribose Phosphate Aldolase From Shewanella Halifaxensis
atgcgtgatctgaagcatgcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtgctggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgacctcgctgctgaccaacctgctgcacaccctggaactggcggacgcgccgcagggtgcgcaaggctat

SEQ ID NO: 374 - protein, 257 aa, Artificial Sequence
  Variant of Deoxyribose Phosphate Aldolase From Shewanella Halifaxensis
MRDLKHAAQRAISLMDLTTLNDDDTDQKVIELCHKAKTPAGDTAAIMIYPRFIPIARKTLNEIGGPDIKIATVTNFPHGNDDIAIAVLETRAAVAYGADEVEVVFPYRALMEGNETVGFELVKACKEACGEDTILKVIIESGVLKDPALIRKASEISIDAGADFIKTSTGKVAVNATLEAAEIMMTVISEKNPKVGFKPAGGIKDAAAAAEFLGVAARLLGDDWATPATFRFGATSLLTNLLHTLELADAPQGAQGY

SEQ ID NO: 375 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 376 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVEVVFPYRALMEGNETVGFELVKACKEACGEDTILKVIIESGVLKDPALIRKASEISIDAGADFIKTSTGKVAVNATLEAAEIMMTVISEKNPKVGFKPAGGIKDAAAAAEFLGVAARLLGDDWATPATFRFGASSLLTNLLHTLELADAPQGAQGY

SEQ ID NO: 377 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcggatgacctgctgaccaacctgctgcacaccctggaactggcggacgcgccgcagggtgcgcaaggctat

SEQ ID NO: 378 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGADDLLTNLLHTLELADAPQGAQGY

SEQ ID NO: 379 - DNA, 771 bp, Artificial Sequence
  Variant of Deoxyribose Phosphate Aldolase From Shewanella Halifaxensis
atgagcgatctgaagaaggcggcgcagcaggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 380 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAIVIYPRFIPIARKTLNEIGGLDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGMKPAGGVKDAAAAAEFLGVAARLLGDDWATPATFRFGASDLLTNLLHTLELADAPQGAQGY

SEQ ID NO: 381 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 382 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGATDLLTNLLHTLELADAPQGAQGY

SEQ ID NO: 383 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 384 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIVTVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGASDLLTNLLHTLELADAPQGAQGY

SEQ ID NO: 385 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 386 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGASSLLTNLLHTLELADAPQGAQGY

SEQ ID NO: 387 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 388 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIMMTVISEKNPKVGFKPAGGVKDAAAAAEFLGVAARLLGDDWATPATFRFGASDLLTNLLHTLELADAPQGAQGY

SEQ ID NO: 389 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtatgaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 390 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGLDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGMKPAGGIKDAAAAAEFLGVAARLLGDDWATPATFRFGATDLLTNLLHTLELADAPQGAQGY

SEQ ID NO: 391 - DNA, 771 bp, Artificial Sequence
  Variant of Deoxyribose Phosphate Aldolase From Shewanella Halifaxensis
atgcgtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 392 - protein, 257 aa, Artificial Sequence
  Variant of Deoxyribose Phosphate Aldolase From Shewanella Halifaxensis
MRDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGATDLLTNLLHTLELADAPQGAQGY

SEQ ID NO: 393 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 394 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGIKDAAAAAEFLGVAARLLGDDWATPATFRFGADSLLTNLLHTLELADAPQGAQGY

SEQ ID NO: 395 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcctggacatcaaaattgccaccgttaccaactttccgcacggtaacgatgacattgcgattgcggtggcggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtatgaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 396 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGLDIKIATVTNFPHGNDDIAIAVAETRAAVAYGADEVEVVFPYRALMEGNETVGFELVKACKEACGEDTILKVIIETGVLKDPALIRKASEISIDAGADFIKTSTGKVAVNATLEAAEIIMTVISEKNPKVGMKPAGGIKDAAAAAEFLGVAARLLGDDWATPATFRFGATDLLTNLLHTLELADAPQGAQGY

SEQ ID NO: 397 - DNA, 771 bp, Artificial Sequence
  Variant of Deoxyribose Phosphate Aldolase From Shewanella Halifaxensis
atgtgtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 398 - protein, 257 aa, Artificial Sequence
  Variant of Deoxyribose Phosphate Aldolase From Shewanella Halifaxensis
MCDLKKAAQRAISLMDLTTLNDDDTDQKVIELCHKAKTPAGDTAAIVIYPRFIPIARKTLNEIGGPDIKIVTVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIMMTVISEKNPKVGMKPAGGVKDAAAAAEFLGVAARLLGDDWATPATFRFGATDLLTNLLHTLELADAPQGAQGY

SEQ ID NO: 399 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 400 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGMKPAGGVKDAAAAAEFLGVAARLLGDDWATPATFRFGADSLLTNLLHTLELADAPQGAQGY

SEQ ID NO: 401 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 402 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVEVVFPYRALMEGNETVGFELVKACKEACGEDTILKVIIESGVLKDPALIRKASEISIDAGADFIKTSTGKVAVNATLEAAEIIMTVISEKNPKVGFKPAGGVKDAAAAAEFLGVAARLLGDDWATPATFRFGATDLLTNLLHTLELADAPQGAQGY

SEQ ID NO: 403 - DNA, 771 bp, Artificial Sequence
  Variant of Deoxyribose Phosphate Aldolase From Shewanella Halifaxensis
atgagtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 404 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVEVVFPYRALMEGNETVGFELVKACKEACGEDTILKVIIETGVLKDPALIRKASEISIDAGADFIKTSTGKVAVNATLEAAEIIMTVISEKNPKVGMKPAGGVKDAAAAAEFLGVAARLLGDDWATPATFRFGATDLLTNLLHTLELADAPQGAQGY

SEQ ID NO: 405 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 406 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGATDLLTNLLHTLELADAPQGAQGY

SEQ ID NO: 407 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 408 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVEVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGASDLLTNLLHTLELADAPQGAQGY

SEQ ID NO: 409 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcctggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 410 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGLDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGMKPAGGVKDAAAAAEFLGVAARLLGDDWATPATFRFGASSLLTNLLHTLELADAPQGAQGY

SEQ ID NO: 411 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 412 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGASDLLTNLLHTLELADAPQGAQGY

SEQ ID NO: 413 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 414 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIIMTVISEKNPKVGFKPAGGVKDAAAAAEFLGVAARLLGDDWATPATFRFGASDLLTNLLHTLELADAPQGAQGY

SEQ ID NO: 415 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 416 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGATDLLTNLLHTLELADAPQGAQGY

SEQ ID NO: 417 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcggatgacctgctgaccaacctgctgcacaccctggaactggcggacgcgccgcagggtgcgcaaggctat

SEQ ID NO: 418 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGADDLLTNLLHTLELADAPQGAQGY

SEQ ID NO: 419 - DNA, 771 bp, Artificial Sequence
  Variant of Deoxyribose Phosphate Aldolase From Shewanella Halifaxensis
atgcgtgatctgaagcatgcggcgcagcaggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcctggacatcaaaattgccaccgttaccaactttccgcacggtaacgatgacattgcgattgcggtggcggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 420 - protein, 257 aa, Artificial Sequence
  Variant of Deoxyribose Phosphate Aldolase From Shewanella Halifaxensis
MRDLKHAAQQAISLMDLTTLNDDDTDQKVIELCHKAKTPAGDTAAIMIYPRFIPIARKTLNEIGGLDIKIATVTNFPHGNDDIAIAVAETRAAVAYGADEVEVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGATDLLTNLLHTLELADAPQGAQGY

SEQ ID NO: 421 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggaagtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 422 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVEVVFPYRALMEGNETVGFELVKACKEACGEDTILKVIIETGVLKDPALIRKASEISIDAGADFIKTSTGKVAVNATLEAAEIIMTVISEKNPKVGFKPAGGIKDAAAAAEFLGVAARLLGDDWATPATFRFGASDLLTNLLHTLELADAPQGAQGY

SEQ ID NO: 423 - DNA, 771 bp, Artificial Sequence
  Variant of Deoxyribose Phosphate Aldolase From Shewanella Halifaxensis
atgcgtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcggatgacctgctgaccaacctgctgcacaccctggaactggcggacgcgccgcagggtgcgcaaggctat

SEQ ID NO: 424 - protein, 257 aa, Artificial Sequence
  Variant of Deoxyribose Phosphate Aldolase From Shewanella Halifaxensis
MRDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVDVVFPYRALMEGNETVGFELVKACKEACGEDTILKVIIESGVLKDPALIRKASEISIDAGADFIKTSTGKVAVNATLEAAEIMMTVISEKNPKVGFKPAGGVKDAAAAAEFLGVAARLLGDDWATPATFRFGADDLLTNLLHTLELADAPQGAQGY

SEQ ID NO: 425 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgtcaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 426 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGLDIKIVTVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGATDLLTNLLHTLELADAPQGAQGY

SEQ ID NO: 427 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtatgaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 428 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGMKPAGGIKDAAAAAEFLGVAARLLGDDWATPATFRFGATDLLTNLLHTLELADAPQGAQGY

SEQ ID NO: 429 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcctggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 430 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGLDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGVKDAAAAAEFLGVAARLLGDDWATPATFRFGATDLLTNLLHTLELADAPQGAQGY

SEQ ID NO: 431 - DNA, 771 bp, Artificial Sequence
  Variant of Deoxyribose Phosphate Aldolase From Shewanella Halifaxensis
atgagtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagctcgctgctgaccaacctgctgcacaccctggaactggcggacgcgccgcagggtgcgcaaggctat

SEQ ID NO: 432 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGLDIKIVTVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIIMTVISEKNPKVGFKPAGGVKDAAAAAEFLGVAARLLGDDWATPATFRFGASSLLTNLLHTLELADAPQGAQGY

SEQ ID NO: 433 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 434 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGASDLLTNLLHTLELADAPQGAQGY

SEQ ID NO: 435 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 436 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIIMTVISEKNPKVGFKPAGGVKDAAAAAEFLGVAARLLGDDWATPATFRFGADSLLTNLLHTLELADAPQGAQGY

SEQ ID NO: 437 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 438 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGASDLLTNLLHTLELADAPQGAQGY

SEQ ID NO: 439 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 440 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGATDLLTNLLHTLELADAPQGAQGY

SEQ ID NO: 441 - DNA, 771 bp, Artificial Sequence
  Variant of Deoxyribose Phosphate Aldolase From Shewanella Halifaxensis
atgtgtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 442 - protein, 257 aa, Artificial Sequence
  Variant of Deoxyribose Phosphate Aldolase From Shewanella Halifaxensis
MCDLKKAAQRAISLMDLTTLNDDDTDQKVIELCHKAKTPAGDTAAIVIYPRFIPIARKTLNEIGGPDIKIVTVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGATDLLTNLLHTLELADAPQGAQGY

SEQ ID NO: 443 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 444 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIVTVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGIKDAAAAAEFLGVAARLLGDDWATPATFRFGADSLLTNLLHTLELADAPQGAQGY

SEQ ID NO: 445 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 446 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIVTVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGIKDAAAAAEFLGVAARLLGDDWATPATFRFGASDLLTNLLHTLELADAPQGAQGY

SEQ ID NO: 447 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 448 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGMKPAGGVKDAAAAAEFLGVAARLLGDDWATPATFRFGATDLLTNLLHTLELADAPQGAQGY

SEQ ID NO: 449 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgagcagcctgctgaccaacctgctgcacaccctggaactggcggacgcgccgcagggtgcgcaaggctat

SEQ ID NO: 450 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGIKDAAAAAEFLGVAARLLGDDWATPATFRFGASSLLTNLLHTLELADAPQGAQGY

SEQ ID NO: 451 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtatgaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 452 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGPDIKIVTVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGMKPAGGVKDAAAAAEFLGVAARLLGDDWATPATFRFGASDLLTNLLHTLELADAPQGAQGY

SEQ ID NO: 453 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagctcgctgctgaccaacctgctgcacaccctggaactggcggacgcgccgcagggtgcgcaaggctat

SEQ ID NO: 454 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGLDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGASSLLTNLLHTLELADAPQGAQGY

SEQ ID NO: 455 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcccggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 456 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGASDLLTNLLHTLELADAPQGAQGY

SEQ ID NO: 457 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtggcggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 458 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIVIYPRFIPIARKTLNEIGGLDIKIATVTNFPHGNDDIAIAVAETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGFKPAGGIKDAAAAAEFLGVAARLLGDDWATPATFRFGATDLLTNLLHTLELADAPQGAQGY

SEQ ID NO: 459 - DNA, 771 bp, Artificial Sequence
  Variant of Deoxyribose Phosphate Aldolase From Shewanella Halifaxensis
atgagcgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaactggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctat

SEQ ID NO: 460 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGIKDAAAAAEFLGVAARLLGDDWATPATFRFGADSLLTNLLHTLELADAPQGAQGY

SEQ ID NO: 461 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgagcgacctgctgaccaacctgctgcacaccctggaactggcggacgcgccgcagggtgcgcaaggctat

SEQ ID NO: 462 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGIKDAAAAAEFLGVAARLLGDDWATPATFRFGASDLLTNLLHTLELADAPQGAQGY

SEQ ID NO: 463 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgttggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcgttaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 464 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGVKDAAAAAEFLGVAARLLGDDWATPATFRFGATDLLTNLLHTLELADAPQGAQGY

SEQ ID NO: 465 - DNA, 771 bp, Artificial Sequence
  Variant of Deoxyribose Phosphate Aldolase From Shewanella Halifaxensis
atgtgtgatctgaagaaggcggcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 466 - protein, 257 aa, Artificial Sequence
  Variant of Deoxyribose Phosphate Aldolase From Shewanella Halifaxensis
MCDLKKAAQRAISLMDLTTLNDDDTDQKVIELCHKAKTPAGDTAAIVIYPRFIPIARKTLNEIGGLDIKIVTVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIIMTVISEKNPKVGFKPAGGIKDAAAAAEFLGVAARLLGDDWATPATFRFGATDLLTNLLHTLELADAPQGAQGY

SEQ ID NO: 467 - DNA, 771 bp, Artificial Sequence
  Variant of Deoxyribose Phosphate Aldolase From Shewanella Halifaxensis
atgagcgatctgaagaaggcggcgcagcaggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcccggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 468 - protein, 257 aa, Artificial Sequence
  Variant of Deoxyribose Phosphate Aldolase From Shewanella Halifaxensis
MSDLKKAAQQAISLMDLTTLNDDDTDQKVIELCHKAKTPAGDTAAIVIYPRFIPIARKTLNEIGGPDIKIVTVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIIMTVISEKNPKVGFKPAGGIKDAAAAAEFLGVAARLLGDDWATPATFRFGATDLLTNLLHTLELADAPQGAQGY

SEQ ID NO: 469 - DNA, 774 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaaccggcgtactgaaagacccggcgctgattcgtaaagcgagcgaaattagcatcgatgcgggtgcggacttcattaagaccagcaccggcaaagttgcggttaacgcgaccctggaggcggcggaaatcatgatgaccgttattagcgagaagaacccgaaagtgggtatgaagccggcgggtggcattaaagatgctgcggcggcggcggaatttctgggtgtggcggcgcgtctgctgggcgatgactgggcgaccccggcgaccttccgttttggtgcggattcgctgctgaccaacctgctgcacaccctggaactggcggacgcgccgcagggtgcgcaaggctattaa

SEQ ID NO: 470 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGLDIKIATVTNFPHGNDDIAIAVLETRAAVAYGADEVDVVFPYRALMEGNETVGFELVKACKEACGEDTILKVIIETGVLKDPALIRKASEISIDAGADFIKTSTGKVAVNATLEAAEIMMTVISEKNPKVGMKPAGGIKDAAAAAEFLGVAARLLGDDWATPATFRFGADSLLTNLLHTLELADAPQGAQGY

SEQ ID NO: 471 - DNA, 771 bp, Artificial Sequence
  Variant of Deoxyribose Phosphate Aldolase From Shewanella Halifaxensis
atgagcgatctgaagaaagcggcgcagcgggcgattagcctgatggatctgaccaccctgaacgacgatgacaccgaccagaaagtgattgagctgtgccacaaagcgaaaaccccggcgggtgacaccgcggcgatcatgatttacccgcgtttcatcccgattgcgcgtaagaccctgaacgaaatcggtggccctgacatcaaaattgcgaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagataccattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 472 - protein, 257 aa, Artificial Sequence
  Variant of Deoxyribose Phosphate Aldolase From Shewanella Halifaxensis
MSDLKKAAQRAISLMDLTTLNDDDTDQKVIELCHKAKTPAGDTAAIMIYPRFIPIARKTLNEIGGPDIKIATVTNFPHGNDDIAIAVLETRAAVAYGADEVDVVFPYRALMEGNETVGFELVKACKEACGEDTILKVIIESGVLKDPALIRKASEISIDAGADFIKTSTGKVAVNATLEAAEIIMTVISEKNPKVGFKPAGGIKDAAAAAEFLGVAARLLGDDWATPATFRFGATDLLTNLLHTLELADAPQGAQGY

SEQ ID NO: 473 - DNA, 771 bp, Artificial Sequence
  Variant of Deoxyribose Phosphate Aldolase From Shewanella Halifaxensis
atgtgcgatctgaagaaggcagcgcagcgggcgattagcctgatggatctgaccaccctgaacgacgatgacaccgaccagaaagtgattgagctgtgccacaaagcgaaaaccccggctggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtggcagagacccgtgcggcgctggcgtacggcgcggatgaagtggacgtggttttcccgtatcgtgcgctgatggaaggtaacgaaaccgtgggctttgagctggttaaggcgtgcaaagaggcgtgcggtgaagatcatattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 474 - protein, 257 aa, Artificial Sequence
  Variant of Deoxyribose Phosphate Aldolase From Shewanella Halifaxensis
MCDLKKAAQRAISLMDLTTLNDDDTDQKVIELCHKAKTPAGDTAAIVIYPRFIPIARKTLNEIGGLDIKIATVTNFPHGNDDIAIAVAETRAALAYGADEVDVVFPYRALMEGNETVGFELVKACKEACGEDHILKVIIESGVLKDPALIRKASEISIDAGADFIKTSTGKVAVNATLEAAEIIMTVISEKNPKVGFKPAGGIKDAAAAAEFLGVAARLLGDDWATPATFRFGATDLLTNLLHTLELADAPQGAQGY

SEQ ID NO: 475 - DNA, 771 bp, Artificial Sequence
  Variant of Deoxyribose Phosphate Aldolase From Shewanella Halifaxensis
atgtgcgatctgaagaaggcagcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatcatattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 476 - protein, 257 aa, Artificial Sequence
  Variant of Deoxyribose Phosphate Aldolase From Shewanella Halifaxensis
MCDLKKAAQRAISLMDLTTLNDDDTDQKVIELCHKAKTPAGDTAAIVIYPRFIPIARKTLNEIGGLDIKIATVTNFPHGNDDIAIAVLETRAAVAYGADEVDVVFPYRALMEGNETVGFELVKACKEACGEDHILKVIIESGVLKDPALIRKASEISIDAGADFIKTSTGKVAVNATLEAAEIIMTVISEKNPKVGFKPAGGIKDAAAAAEFLGVAARLLGDDWATPATFRFGATDLLTNLLHTLELADAPQGAQGY

SEQ ID NO: 477 - DNA, 771 bp, Artificial Sequence
  Variant of Deoxyribose Phosphate Aldolase From Shewanella Halifaxensis
atgtgcgatctgaagaaggcagcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgtcaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatcatattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 478 - protein, 257 aa, Artificial Sequence
  Variant of Deoxyribose Phosphate Aldolase From Shewanella Halifaxensis
MCDLKKAAQRAISLMDLTTLNDDDTDQKVIELCHKAKTPAGDTAAIVIYPRFIPIARKTLNEIGGLDIKIVTVTNFPHGNDDIAIAVLETRAAVAYGADEVDVVFPYRALMEGNETVGFELVKACKEACGEDHILKVIIESGVLKDPALIRKASEISIDAGADFIKTSTGKVAVNATLEAAEIIMTVISEKNPKVGFKPAGGIKDAAAAAEFLGVAARLLGDDWATPATFRFGATDLLTNLLHTLELADAPQGAQGY

SEQ ID NO: 479 - DNA, 1221 bp, Artificial Sequence
  ENGINEERED PHOSPHOPENTOMUTASE VARIANT ENZYMES
atgaaacgtgcatttattatggtgctggactcattcggcatcggcgctacagaagatgcagaacgctttggtgacgtcggggctgacaccctgggtcatatcgcagaagcttgtgccaaaggcgaagctgataacggtcgtaaaggcccgctcaatctgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatatttcaccgatcacgaaaacagcttcccgcaagagctgctggataaactggtcgaacgcgctaatctgccgggttacctcggtaactgccgtgcgtccggtacggtcattctagatcaactgggcgaagagcacatgaaaaccggcaagccgattttctatacctccgcagcatccgtgttccagattgcctgccatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtaccggtaaccgtcgtgacctggctatagagccgggggcaccgaccgtgctgcagaaactggttgatgaaaaacacggccaggtggtttcggcgggtaaaattgccgacatctacgccaaccgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaccggtcatgaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 480 - protein, 407 aa, Artificial Sequence
  ENGINEERED PHOSPHOPENTOMUTASE VARIANT ENZYMES
MKRAFIMVLDSFGIGATEDAERFGDVGADTLGHIAEACAKGEADNGRKGPLNLPNLTRLGLAKAHEGSTGFIPAGMDGNAEVIGAYAWAHEMSSGKDSLSGHWEIAGVPVLFEMGYFTDHENSFPQELLDKLVERANLPGYLGNCRASGTVILDQLGEEHMKTGKPIFYTSAASVFQIACHEETFGLDKLYELCEIAREELTNGGYNIGRVIARPFIGDKAGNFQRTGNRRDLAIEPGAPTVLQKLVDEKHGQVVSAGKIADIYANRGITKKVKATGLDALFDATIKEMKEAGDNTIVFTCFVDFDSSWGHRRDVAGYAAGLELFDRRLPELMSLLRDDDILILTADHGCDPTWTGHDHTREHIPVLVYGPKVKPGSLGHRETFADIGQTLAKYFGTSDMEYGKAMF

SEQ ID NO: 481 - DNA, 717 bp, Artificial Sequence
  Variant of Purine Nucleoside Phosphorylase from E. Coli
atgacgaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtgctggtatcccgagctgctccatctacaccaaagaactgatcaccgacttcggcgtgaagaaaattatccgcgtgggtacttgtggcgcagttctgccgcacgtaaaactgcgcgacgtcgttatcggtatgggtgcctgcaccgattccaaagttaaccgcatccgttttaaagaccatgactttgccgctatcgctgacttcgacatggtgcgtaacgcagtagatgcagctaaagcactgggtattgatccgcgcgtgggtaacctgcattccgctgacctgttctactctccggacggcgaaatgttcgacgtgatggaaaaatacggcattgtgggcgtggaaatggaagcggctggtatctacggcgtcgctgcagaatttggcgcgaaagccctgaccatctgcaccgtatctgaccacatccgcactcacgaggctaccactgcggctgagcgtcagactaccttcaacgacatgatcaaaatcgcactggaatccgttctgctgggcgataaagag

SEQ ID NO: 482 - protein, 239 aa, Artificial Sequence
  Variant of Purine Nucleoside Phosphorylase from E. Coli
MTTPHINAEMGDFADVVLMPGDPLRAKYIAETFLEDAREVNNVRGMLGFTGTYKGRKISVMGHGAGIPSCSIYTKELITDFGVKKIIRVGTCGAVLPHVKLRDVVIGMGACTDSKVNRIRFKDHDFAAIADFDMVRNAVDAAKALGIDPRVGNLHSADLFYSPDGEMFDVMEKYGIVGVEMEAAGIYGVAAEFGAKALTICTVSDHIRTHEATTAAERQTTFNDMIKIALESVLLGDKE

SEQ ID NO: 483 - DNA, 1500 bp, Artificial Sequence
  Variant of  Sucrose phosphorylase from Alloscardovia omnicolens
atgaagaacaaagttcaactgattacctacgcggatcgtctgggtgacggcaccctgaagagcatgaccgagaccctgcgtaaacacttcgagggtgtttatgaaggcgtgcacatcctgccgttctttaccccgttcgatggtgcggacgcgggctttgatccggttgaccacaccaaagtggacccgcgtctgggtagctgggacgatgtggcggaactgagcaccacccacgatatcatggttgacaccattgtgaaccacatgagctgggagagcgaacagttccaagatgttatggcgaagggcgaggacagcgaatactatccgatgttcctgaccatgagcagcatttttccggatggtgtgaccgaggaagacctgaccgcgatctatcgtccgcgtccgggtctgccgttcacccactataactggggtggcaaaacccgtctggtttggaccacctttaccccgcagcaagtggacattgataccgacagcgagatgggttggaactacctgctgagcatcctggatcagctgagccaaagccacgttagccaaattcgtctggacgcggtgggttatggcgcgaaggagaaaaacagcagctgcttcatgaccccgaagacctttaaactgatcgaacgtattaaggcggagggtgaaaaacgtggcctggagaccctgatcgaagttcacagctactataagaaacaggtggagattgcgagcaaggtggatcgtgtttacgactttgcgatcccgggtctgctgctgcatgcgctggaatttggcaaaaccgatgcgctggcgcaatggattgacgttcgtccgaacaacgcggtgaacgttctggatacccacgacggtatcggcgttatcgatattggtagcgatcagatggaccgtagcctggcgggtctggtgccggatgaggaagttgacgcgctggttgagagcatccaccgtaacagcaagggtgaaagccaggaagcgaccggcgcggcggcgagcaacctggacctgtaccaagttaactgcacctactatgcggcgctgggtagcgacgatcagaaatatattgcggcgcgtgcggtgcagttctttatgccgggcgtgccgcaagtttactatgtgggtgcgctggcgggcagcaacgatatggacctgctgaagcgtaccaacgtgggtcgtgatatcaaccgtcactactatagcgcggcggaagtggcgagcgaggtggaacgtccggtggttcaggcgctgaacgcgctgggccgtttccgtaacaccctgagcgcgttcgatggtgaatttagctacagcaacgcggacggcgttctgaccatgacctgggcggatgatgcgacccgtgcgaccctgacctttgcgccgaaggcgaacagcaacggtgcgagcgtggcgcgtctggagtggaccgatgcggcgggtgaacatgcgaccgacgatctgatcgcgaacccgccggtggttgcg

SEQ ID NO: 484 - protein, 500 aa, Artificial Sequence
  Sucrose phosphorylase from Alloscardovia omnicolens
MKNKVQLITYADRLGDGTLKSMTETLRKHFEGVYEGVHILPFFTPFDGADAGFDPVDHTKVDPRLGSWDDVAELSTTHDIMVDTIVNHMSWESEQFQDVMAKGEDSEYYPMFLTMSSIFPDGVTEEDLTAIYRPRPGLPFTHYNWGGKTRLVWTTFTPQQVDIDTDSEMGWNYLLSILDQLSQSHVSQIRLDAVGYGAKEKNSSCFMTPKTFKLIERIKAEGEKRGLETLIEVHSYYKKQVEIASKVDRVYDFAIPGLLLHALEFGKTDALAQWIDVRPNNAVNVLDTHDGIGVIDIGSDQMDRSLAGLVPDEEVDALVESIHRNSKGESQEATGAAASNLDLYQVNCTYYAALGSDDQKYIAARAVQFFMPGVPQVYYVGALAGSNDMDLLKRTNVGRDINRHYYSAAEVASEVERPVVQALNALGRFRNTLSAFDGEFSYSNADGVLTMTWADDATRATLTFAPKANSNGASVARLEWTDAAGEHATDDLIANPPVVA

We claim:

1. An engineered deoxyribose-phosphate aldolase comprising a polypeptide sequence having at least 95% sequence identity to SEQ ID NO: 2 or a functional fragment thereof, wherein said engineered deoxyribose-phosphate aldolase comprises a substitution in said polypeptide sequence of X145C/R/K, and wherein said engineered deoxyribose-phosphate aldolase has at least 1.2 fold increased activity on (R)-2-ethynyl-glyceraldehyde as compared to the wild-type polypeptide sequence of SEQ ID NO:2, and wherein the amino acid positions of said polypeptide sequence are numbered with reference to SEQ ID NO: 2.

2. The engineered deoxyribose-phosphate aldolase of claim 1, wherein said engineered deoxyribose-phosphate aldolase comprises a polypeptide sequence that is at least 95% identical to the sequence of at least one engineered deoxyribose-phosphate aldolase variant set forth in the even numbered sequences of SEQ ID NOS: 6, 12, 42, 104, or 140-478.

3. The engineered deoxyribose-phosphate aldolase of claim 1, wherein said engineered deoxyribose-phosphate aldolase comprises a polypeptide sequence set forth in the even numbered sequences of SEQ ID NOS: 6, 12, 42, 104, or and 140-478.

4. The engineered deoxyribose-phosphate aldolase of claim 1, wherein said engineered deoxyribose-phosphate aldolase is purified.

5. A composition comprising at least one engineered deoxyribose-phosphate aldolase provided in claim 1.

* * * * *